United States Patent
Uil et al.

(10) Patent No.: US 11,872,281 B2
(45) Date of Patent: Jan. 16, 2024

(54) ADENOVIRUS AND USES THEREOF

(71) Applicant: JANSSEN VACCINES & PREVENTION B.V., Leiden (NL)

(72) Inventors: Taco Gilles Uil, Amsterdam (NL); Soumitra Roy, Townsend, DE (US); Selina Khan, Leiden (NL); Jerôme H. H. V. Custers, Alphen aan den Rijn (NL)

(73) Assignee: Janssen Vaccines & Prevention B.V., Leiden (NL)

( * ) Notice: Subject to any disclaimer, the term of this patent is extended or adjusted under 35 U.S.C. 154(b) by 752 days.

(21) Appl. No.: 16/760,269

(22) PCT Filed: Oct. 30, 2018

(86) PCT No.: PCT/EP2018/079704
§ 371 (c)(1),
(2) Date: Apr. 29, 2020

(87) PCT Pub. No.: WO2019/086450
PCT Pub. Date: May 9, 2019

(65) Prior Publication Data
US 2020/0323977 A1    Oct. 15, 2020

(30) Foreign Application Priority Data

Oct. 31, 2017 (EP) ..................................... 17199347

(51) Int. Cl.
*C12N 15/00* (2006.01)
*A61K 39/235* (2006.01)
*C12N 15/86* (2006.01)

(52) U.S. Cl.
CPC ............ *A61K 39/235* (2013.01); *C12N 15/86* (2013.01); *C12N 2710/10321* (2013.01); *C12N 2710/10322* (2013.01); *C12N 2710/10334* (2013.01); *C12N 2710/10342* (2013.01); *C12N 2710/10343* (2013.01)

(58) Field of Classification Search
None
See application file for complete search history.

(56) References Cited

U.S. PATENT DOCUMENTS

| | | | |
|---|---|---|---|
| 5,559,099 A | 9/1996 | Wickham et al. |
| 5,837,511 A | 11/1998 | Falck-Pedersen et al. |
| 5,846,782 A | 12/1998 | Wickham et al. |
| 5,851,806 A | 12/1998 | Kovesdi et al. |
| 5,891,690 A | 4/1999 | Massie |

(Continued)

FOREIGN PATENT DOCUMENTS

| | | |
|---|---|---|
| EP | 2 350 268 | 8/2011 |
| EP | 2 536 829 | 12/2012 |

(Continued)

OTHER PUBLICATIONS

Altschul et al., "Basic Local Alignment Search Tool," (1990) J. Mol. Biol. 215: 403-410.

(Continued)

*Primary Examiner* — M Franco G Salvoza
(74) *Attorney, Agent, or Firm* — Ice Miller LLP

(57) ABSTRACT

Provided herein are adenoviral nucleic acid sequences and adenoviral vectors comprising said nucleic acid sequences. The provided adenoviral vectors can be used to induce a protective immune response in a subject.

25 Claims, 20 Drawing Sheets

Specification includes a Sequence Listing.

(56) References Cited

U.S. PATENT DOCUMENTS

| | | | |
|---|---|---|---|
| 5,965,541 A | 10/1999 | Wickham et al. |
| 5,981,225 A | 11/1999 | Kochanek et al. |
| 5,994,106 A | 11/1999 | Kovesdi et al. |
| 5,994,128 A | 11/1999 | Fallaux et al. |
| 6,020,191 A | 2/2000 | Scaria et al. |
| 6,040,174 A | 3/2000 | Imler et al. |
| 6,113,913 A | 9/2000 | Brough et al. |

FOREIGN PATENT DOCUMENTS

| | | |
|---|---|---|
| WO | 98/39411 | 9/1998 |
| WO | 01/36615 | 5/2001 |
| WO | 2002/22080 | 3/2002 |
| WO | 2003/000283 | 1/2003 |
| WO | 2003/104467 | 12/2003 |
| WO | 2004/037189 | 5/2004 |
| WO | 2005/071093 | 8/2005 |
| WO | 2006/040330 | 4/2006 |
| WO | 2007/104792 | 9/2007 |
| WO | 2009/073104 | 6/2009 |
| WO | 2010/086189 | 8/2010 |
| WO | 2001/02607 | 1/2011 |
| WO | 2011/130627 | 10/2011 |
| WO | 2013/016591 | 1/2013 |
| WO | 2013/052859 | 4/2013 |
| WO | 2013/173702 | 11/2013 |

OTHER PUBLICATIONS

Altschul et al., "Gapped BLAST and PSI-BLAST: a new generation of protein database search programs," (1997) Nucleic Acids Res. 25: 3389-3402.
Barnes E, et al., "Novel Adenovirus-Based Vaccines Induce Broad and Sustained T Cell Responses to HCV in Man," 2012 Science translational medicine 4: 115ra1.
Fallaux et al., "New Helper Cells and Matched Early Region 1-Deleted Adenovirus Vectors Prevent Generation of Replication-Competent Adenovirus," 1998, Hum Gene Ther 9: 1909-17.
Gao et al., "A Cell Line for High-Yield Production of E1-Deleted Adenovirus Vectors without the Emergence of Replication-Competent Virus," 2000, Hum Gene Ther 11: 213-19.
Havenga et al., "Novel replication-incompetent adenoviral B-group vectors: high vector stability and yield in PER.C6 cells," J. Gen. Virol. 87(8):2135-43 (2006).
Henikoff & Henikoff, Proc. Natl. Acad. Sci. USA 89:10915 (1989).
Karlin & Altschul, "Amino acid substitution matrices from protein blocks," Proc. Nat'l. Acad. Sci. USA, 90: 5873-5787 (1993).
Kovesdi et al., "Adenoviral Producer Cells," 2010, Viruses 2: 1681-703.
Letvin et al., "Prospects for Vaccine Protection Against HIV-1 Infection and AIDS," Ann. Rev. Immunol. 20:73 (2002).
Maizel et al., "The Polypeptides of Adenovirus," Virology, 36(1):115-25 (1968).
Needleman & Wunsch, "A General Method Applicable to the Search for Similarities in the Amino Acid Sequence of Two Proteins," J. Mol. Biol. 48:443 (1970).
Pearson & Lipman, "Improved tools for biological sequence comparison," Proc. Nat'l. Acad. Sci. USA 85:2444 (1988).
Peruzzi D, et al., A novel Chimpanzee serotype-based adenoviral vector as delivery tool for cancer vaccines, 2009 Vaccine 27: 1293-300.
Quinn KM, et al., "Comparative Analysis of the Magnitude, Quality, Phenotype, and Protective Capacity of Simian Immunodeficiency Virus Gag-Specific CD8 T Cells following Human-, Simian-, and Chimpanzee-Derived Recombinant Adenoviral Vector Immunization," 2013, J Immunol 190: 2720-35.

Shiver et al., "Replication-incompetent adenoviral vacccine vector elicits effective anti-immunodeficiency-virus immunity," Nature 415:331 (2002).
Shiver and Emini, "Recent Advances in the Development of HIV-1 Vaccines Using Replication-Incompetent Adenovirus Vectors," Ann. Rev. Med. 55:355 (2004).
Smith & Waterman, "Comparison of Biosequences," Adv. Appl. Math. 2:482 (1981).
Sprangers et al., "Quantifying Adenovirus-Neutralizing Antibodies by Luciferase Transgene Detection: Addressing Preexisting Immunity to Vaccine and Gene Therapy Vectors," 2003, J.Clin. Microbiol. 41:5046-5052.
Susan J. Morris et al., "Simian adenoviruses as vaccine vectors," Future Virology, 11(9):649-659, 2016.
R.R. Bradley et al., "Adenovirus Serotype 5 Neutralizing Antibodies Target both Hexon and Fiber following Vaccination and Natural Infection," Journal of Virology, 86(1):625-629, 2011.
S.C. Jacobs, "Characterization and manipulation of the human adenovirus 4 genome," Journal of General Virology, 85(11):3361-3366, 2004.
Roberts Diane M. et al., "Hexon-chimaeric adenovirus serotype 5 vectors circumvent pre-existing anti-vector immunity," Nature, Macmillan Journals Ltd., London, 441(7090):239-243, 2006.
Julio Alonso-Padilla et al., "Development of Novel Adenoviral Vectors to Overcome Challenges Observed with HAdV-5-based Constructs," Molecular Therapy: The Journal of the American Society of Gene Therapy, 24(1):6-16, 2015.
Mohan Babu Appaiahgari et al., "Adenoviruses as gene/vaccine delivery vectors: promises and pitfalls," Expert Opinion on Biological Therapy, 15(3):337-351, 2014.
Abbink et al., "Comparative Seroprevalence and Immunogenicity of Six Rare Serotype Recombinant Adenovirus Vaccine Vectors from Subgroups B and D," Journal of Virology, 81(9):4654-4663, 2007.
Alba et al., "Vector Systems for Prenatal Gene Therapy: Principles of Adenovirus Design and Production," Methods in Molecular Biology, 891:55-84, 2012.
Bradley, et al., "Adenovirus Serotype 5-Specific Neutralizing Antibodies Target Multiple Hexon Hypervariable Regions," Journal of Virology, 86:1267-72, 2012.
Bruder et al., "Modification of Ad5 Hexon Hypervaribable Regions Circumvents Pre-Existing Ad5 Neutralizing Antibodies and Induces Protective Immune Responses," PLoS ONE, 7(4):e33920, 2012.
Gall et al., "Construction and Characterization of Hexon-Chimeric Adenoviruses: Specification of Adenovirus Serotype," Journal of Virology, 72(12):10260-10264, 1998.
Ma et al., "Synergistic suppression effect on tumor growth of hepatocellular carcinoma by combining oncolytic adenovirus carrying XAF1 with cisplatin," J Cancer Res Clin Oncol, 141:419-429, 2015.
Roy et al., "Circumvention of Immunity to the Adenovirus Major Coat Protein Hexon," Journal of Virology, 72(8):6875-6879, 1998.
Roy et al., "Use of chimeric adenoviral vectors to assess capsid neutralization determinants," Virology, 333:207-214, 2005.
Wu et al., "Construction and Characterization of Adenovirus Serotype 5 Packages by Serotype 3 Hexon," Journal of Virology, 76(24):12775-12782, 2002.
Youil et al., "Hexon Gene Switch Strategy for the Generation of Chimeric Recombinant Adenovirus," Human Gene Therapy, 13:311-320, 2002.
Yu et al., "Chimeric hexon HVRs protein reflects partial function of adenovirus," Biochemical and Biophysical Research Communication, 421:170-176, 2012.
Wevers et al., "Novel Adenoviruses in Wild Primates: a High Level of Genetic Diversity and Evidence of Zoonotic Transmissions," Journal of Virology, 85(20):10774-10784, 2011.
Ma et al., "Manipulating Adenovirus Hexon Hypervariable Loops Dictates Immune Neutralisation and Coagulation Factor X-dependent Cell Interaction In Vitro and In Vivo," PLoS Pathog, 11(2):e1004673, 2015.

```
BB21 fiber         MSKKRARVDD GFDPVYPYDA DNAPTVPFIN PPFVSSDGFQ EKPLGVLSLR  50
BB21 fiber variant ........................................................  50
BB24 fiber         ........................................................  50

BB21 fiber         LADPVTTKNG AVTLKLGEGV DLDDSGKLIS KNATKATAPL SISNNTISLN 100
BB21 fiber variant ........................................................ 100
BB24 fiber         ........................................................ 100

BB21 fiber         MDAPLYNNNG KLGIRIGAPL KVVDLLNTLA VAYGSGLGLK NNALTVQLVS 150
BB21 fiber variant ..........................▓............................. 150
BB24 fiber         ........................................................ 150

BB21 fiber         PLTFDNKGNV KINLGNGPLT VAANRLSVTC KRGLYVTTTG DALESNISWA 200
BB21 fiber variant ........................................................ 200
BB24 fiber         ........................................................ 200

BB21 fiber         KGIRFEGNAI AANIGKGLEF GTTSSESDVS NAYPIQVKLG TGLTFDSTGA 250
BB21 fiber variant ........................................................ 250
BB24 fiber         ........................................................ 250

BB21 fiber         IVAWNKEDDK LTLWTTADPS PNCKIYSEKD AKLTLCLTKC GSQILGTVTV 300
BB21 fiber variant ........................................................ 300
BB24 fiber         ........................................................ 300

BB21 fiber         LAVNNGSLNP ITNAVSTAIV YLKFDANGVL LSNSTLNKEY WNFRKGDVTP 350
BB21 fiber variant ..........▓............................................. 350
BB24 fiber         ........................................................ 350

BB21 fiber         AEAYTNAIGF MPNIKAYPKN TNVASKSHIV GQVYLNGDET KPLMLIITFN 400
BB21 fiber variant ........................................................ 400
BB24 fiber         ........................................................ 400

BB21 fiber         ETDDATCTYC ITFQWKWDNS KYTGETLATS SFPFSYIAQE 440
BB21 fiber variant .........▓................................. 440
BB24 fiber         ........................................... 440
```

FIG. 16

ADENOVIRUS AND USES THEREOF

CROSS-REFERENCE TO RELATED APPLICATIONS

This application is a Section 371 of International Application No. PCT/EP2018/079704, filed Oct. 30, 2018, which was published in the English language on May 9, 2019 under International Publication No. WO 2019/086450 A1, and claims priority under 35 U.S.C. § 119(b) to European Application No. 17199347.0, filed Oct. 31, 2017, the disclosures of which are incorporated herein by reference in their entirety.

REFERENCE TO SEQUENCE LISTING SUBMITTED ELECTRONICALLY

This application contains a sequence listing, which is submitted electronically via EFS-Web and an ASCII formatted sequence listing with a file name "065768.11649_SL", creation date of Apr. 29, 2020, and having a size of 1,549 KB. The sequence listing submitted via EFS-Web is part of the specification and is herein incorporated by reference in its entirety.

FIELD OF THE INVENTION

This invention relates to biotechnology. More particularly, to the field and use of adenoviral vectors, such as replication defective adenoviral vectors to deliver antigens and elicit an immune response in hosts.

BACKGROUND OF THE INVENTION

Recombinant adenoviral vectors are widely applied for gene therapy applications and vaccines. AdV-5 vector-based vaccines have been shown to elicit potent and protective immune responses in a variety of animal models (see, e.g., WO2001/02607; WO2002/22080; Shiver et al., Nature 415: 331 (2002); Letvin et al., Ann. Rev. Immunol. 20:73 (2002); Shiver and Emini, Ann. Rev. Med. 55:355 (2004)). However, the utility of recombinant AdV-5 vector-based vaccines will likely be limited by the high seroprevalence of AdV-5-specific neutralizing antibodies (NAbs) in human populations. The existence of anti-AdV-5 immunity has been shown to substantially suppress the immunogenicity of AdV-5-based vaccines in studies in mice, rhesus monkeys, and humans.

One promising strategy to circumvent the existence of pre-existing immunity in individuals previously infected or treated with the most common human adenovirus, e.g., AdV-5, involves the development of recombinant vectors from adenovirus serotypes that do not encounter such pre-existing immunities. One such strategy is based on the use of non-human simian adenoviruses since these do not typically infect humans and exhibit low seroprevalence in human samples. Non-human simian adenoviruses are applicable for human use since it was shown that these viruses could infect human cells in vitro (WO2003/000283; WO2004/037189).

Thus, there is a need in the field for alternative adenoviral vectors that are producible in large quantities, that do not encounter pre-existing immunities in the host, but that are still immunogenic and capable of inducing a strong immune response against the antigens encoded by the heterologous nucleic acids inserted in the vector.

BRIEF SUMMARY OF THE INVENTION

Provided herein are isolated nucleic acid sequences. The isolated nucleic acid sequences encode a fiber polypeptide with at least 98% identity to amino acids 6-375 of SEQ ID NO:2. In certain embodiments, the fiber polypeptide comprises the amino acid sequence selected from a BB21 fiber polypeptide (SEQ ID NO:2), a BB21 fiber variant polypeptide (SEQ ID NO:3), or a BB24 fiber polypeptide (SEQ ID NO:4). In certain embodiments, the isolated nucleic acid sequence further comprises a hexon nucleic acid sequence encoding a hexon polypeptide comprising hexon hypervariable regions having the amino acid sequence selected from SEQ ID NO:5 or SEQ ID NO:6. In certain embodiments, the hexon polypeptide comprises the amino acid sequence selected from a BB21 hexon polypeptide (SEQ ID NO:7) or a BB24 hexon polypeptide (SEQ ID NO:8).

Also provided are isolated nucleic acid sequences encoding a hexon polypeptide comprising a hexon hypervariable regions-encompassing polypeptide having an amino acid sequence selected from SEQ ID NO:5 or SEQ ID NO:6. In certain embodiments, the hexon polypeptide comprises the amino acid sequence selected from a BB21 hexon polypeptide (SEQ ID NO:7) or a BB24 hexon polypeptide (SEQ ID NO:8).

Embodiments of the invention also include isolated fiber and hexon polypeptides encoded by the fiber and hexon nucleic acid sequences of the invention.

In certain embodiments, provided herein are isolated nucleic acids comprising a hexon nucleic acid sequence encoding at least one of the hexon polypeptides disclosed herein, and a nucleic acid sequence encoding at least one of the fiber polypeptides disclosed herein. In certain embodiments, provided herein are vectors comprising the isolated nucleic acids described herein. In one embodiment, the vector is a viral vector. In another embodiment, the vector is an expression vector. In one preferred embodiment, the vector is an adenoviral vector. More preferably, the vector further comprises a transgene.

Also provided are recombinant cells comprising the vectors described herein. Such cells can be used for recombinant protein production, recombinant protein expression, or the production of vectors or viral particles. Also provided are methods of producing a vector. The methods comprise (a) growing the recombinant cell disclosed herein under conditions for production of the vector; and (b) isolating the vector from the recombinant cell.

In certain embodiments, provided are immunogenic compositions comprising the vectors disclosed herein. Also provided are methods of inducing an immune response in a subject in need thereof, comprising administering to the subject the immunogenic compositions disclosed herein.

Further provided are adenoviral vectors comprising (a) at least one transgene insertion site; and (b) a nucleic acid sequence encoding a fiber polypeptide, wherein the fiber polypeptide comprises an amino acid sequence with at least 98% identity to amino acids 6-375 of SEQ ID NO:2. In certain embodiments, the fiber polypeptide comprises the amino acid sequence selected from a BB21 fiber polypeptide (SEQ ID NO:2), a BB21 fiber variant polypeptide (SEQ ID NO:3), or a BB24 fiber polypeptide (SEQ ID NO:4). In certain embodiments, adenoviral vector further comprises a hexon nucleic acid sequence encoding a hexon polypeptide comprising a hexon hypervariable regions-encompassing polypeptide having the amino acid sequence selected from SEQ ID NO:5 or SEQ ID NO:6. In certain embodiments, the hexon polypeptide comprises the amino acid sequence selected from a BB21 hexon polypeptide (SEQ ID NO:7) or a BB24 hexon polypeptide (SEQ ID NO:8).

Further provided are adenoviral vectors comprising (a) at least one transgene insertion site; and (b) a nucleic acid sequence encoding a hexon polypeptide, wherein the hexon polypeptide comprises a hexon hypervariable regions-encompassing polypeptide having the amino acid sequence selected from SEQ ID NO:5 or SEQ ID NO:6. In certain embodiments, the hexon polypeptide comprises the amino acid sequence selected from a BB21 hexon polypeptide (SEQ ID NO:7) or a BB24 hexon polypeptide (SEQ ID NO:8).

In certain embodiments, the adenoviral vectors provided herein are replication-defective adenovirus vectors (rAd). In one embodiment, the adenoviral vectors can comprise an E1 deletion. In certain embodiments, the adenoviral vectors provided herein can further comprise an E3 deletion. The adenoviral vectors can be simian adenoviral vectors comprising adenoviral nucleic acid sequences from one or more simian adenoviruses (SAdV), such as chimpanzee adenoviruses (e.g., ChAd3); gorilla adenoviruses; or rhesus adenoviruses (e.g., rhAd51, rhAd52 or rhAd53). The adenoviral vectors can be human adenoviral vectors comprising adenoviral sequences from one or more human adenoviruses (e.g., hAdV-4, hAdV-5, hAdV-26, hAdV-35). Preferably, the adenoviral vector is a chimeric adenoviral vector comprising one or more human adenoviral nucleic acid sequences. The human adenoviral nucleic acid sequences can, for example, be from human adenovirus-4 (hAdV-4), human adenovirus-5 (hAdV-5), human adenovirus-26 (hAdV-26), or human adenovirus-35 (hAdV-35). The adenoviral vectors can, for example, comprise a human adenovirus-5 (hAdV-5) E4 orf6 and orf 6/7.

In certain embodiments, the transgene insertion site is adjacent to an inverted terminal repeat (ITR). In certain embodiments, a transgene is inserted at one or more transgene insertion sites selected from the group consisting of a transgene insertion site at or adjacent to the E1 deletion, a transgene insertion site at or adjacent to the E3 deletion, and the transgene insertion site adjacent to the ITR, e.g., in between the E4 region and the right ITR (RITR).

In certain embodiments, the adenoviral vectors provided herein comprise a nucleic acid sequence selected from the group consisting of SEQ ID NO:28, SEQ ID NO:29, SEQ ID NO:30, SEQ ID NO:31, SEQ ID NO:53, and SEQ ID NO:57.

Also provided are immunogenic compositions or vaccines comprising the adenoviral vectors described herein and a pharmaceutically acceptable carrier. Further provided are methods for inducing an immune response in a subject in need thereof. The methods comprise administering to the subject the vaccines disclosed herein. Further provided are methods of producing a vaccine. The methods comprise combining an adenoviral vector disclosed herein with a pharmaceutically acceptable carrier.

BRIEF DESCRIPTION OF THE DRAWINGS

The foregoing summary, as well as the following detailed description of preferred embodiments of the present application, will be better understood when read in conjunction with the appended drawings. It should be understood, however, that the application is not limited to the precise embodiments shown in the drawings.

FIG. 1A shows the experimental set-up, this setup was also used for the experiments shown in FIG. 2 and FIG. 3. FIG. 1B shows a graph of the cellular immune responses induced by Ad26.FLuc, BB21.FLuc and BB24.FLuc against the vector-encoded antigen (i.e. Fluc, firefly luciferase) as determined by Interferon gamma (IFN-γ) ELISPOT analysis. The y-axis shows the number of Spot Forming Units (SFU) per $10^6$ splenocytes and the dotted line indicates 95% percentile of the medium stimuli.

FIG. 4A shows the experimental set-up, this setup was also used for the experiments shown in FIG. 5 and FIG. 6. FIG. 4B shows results of a respiratory syncytial virus neutralization assay (VNA) performed at eight weeks after immunization with Ad26.RSVF-2A-GLuc and with BB21.RSVF-2A-GLuc at three different concentrations ($10^8$, $10^9$ and $10^{10}$ vp), or with Ad26.FLuc and BB21.FLuc at $10^{10}$ vp. The graph depicts VNA titers against respiratory syncytial virus strain A2 (RSV A2) calculated as endpoint titers ($\log_2$). FIG. 4C shows the cellular immune responses induced by Ad26.RSVF-2A-GLuc and BB21.RSVF-2A-GLuc against the vector-encoded antigen RSV F as determined by IFN-γ ELISPOT analysis. FIG. 4D shows a graph of RSV F-specific IgG binding antibody titers induced by Ad26.RSVF-2A-GLuc and BB21.RSVF-2A-GLuc in serum of immunized mice at 8 weeks post-immunization. The graph depicts IgG ELISA titers calculated as endpoint titers ($\log_{10}$).

FIG. 5A shows results of a respiratory syncytial virus neutralization assay (VNA) performed at eight weeks after immunization with Ad26.RSVF-2A-GLuc, BB24.RSVF-2A-GLuc and Ad48.RSVF-2A-GLuc at three different concentrations ($10^8$, $10^9$ and $10^{10}$vp), or with Ad26.FLuc, BB24.FLuc and Ad48.FLuc at $10^{10}$ vp. The graph depicts VNA titers against RSV A2 calculated as endpoint titers ($\log_2$). FIG. 5B shows the cellular immune response induced by Ad26.RSVF-2A-GLuc, BB24.RSVF-2A-GLuc and Ad48.RSVF-2A-GLuc against the vector-encoded antigen RSV F as determined by IFN-γ ELISPOT analysis. FIG. 5C shows a graph of RSV F-specific IgG binding antibody titers induced by Ad26.RSVF-2A-GLuc, BB24.RSVF-2A-GLuc and Ad48.RSVF-2A-GLuc in serum of immunized mice at 8 weeks post-immunization. The graph depicts IgG ELISA titers calculated as endpoint titers ($\log_{10}$).

FIG. 6A shows results of a respiratory syncytial virus neutralization assay (VNA) performed at eight weeks after immunization with Ad26.RSVF-2A-GLuc, Ad4Ptr01-BB24.RSVF-2A-GLuc and Ad4Ptr13-BB21.RSVF-2A-GLuc at three different concentrations ($10^8$, $10^9$ and $10^{10}$ vp), or with Ad26.FLuc, Ad4Ptr01-BB24.FLuc and Ad4Ptr13-BB21.FLuc at $10^{10}$ vp. The graph depicts VNA titers against RSV A2 calculated as endpoint titers ($\log_2$). FIG. 6B shows the cellular immune response induced by Ad26.RSVF-2A-GLuc, Ad4Ptr01-BB24.RSVF-2A-GLuc and Ad4Ptr13-BB21.RSVF-2A-GLuc against the vector-encoded antigen RSV F as determined by IFN-γ ELISPOT analysis. FIG. 6C shows a graph of RSV F-specific IgG binding antibody titers induced by Ad26.RSVF-2A-GLuc, Ad4Ptr01-BB24.RSVF-2A-GLuc and Ad4Ptr13-BB21.RSVF-2A-GLuc in serum of immunized mice at 8 weeks post-immunization. The graph depicts IgG ELISA titers calculated as endpoint titers ($\log_{10}$).

FIG. 16 shows an alignment of BB21 fiber (SEQ ID NO:2), BB21 fiber variant (SEQ ID NO:3), and BB24 fiber (SEQ ID NO:4).

DETAILED DESCRIPTION OF THE INVENTION

Figure 1A:
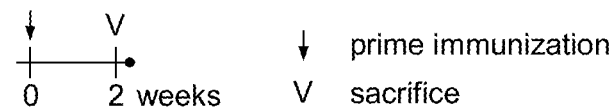
FIG. 1A-FIG. 1B show cellular immune responses induced by BB21.FLuc and BB24.FLuc.

This disclosure is based upon, at least in part, the isolation and identification of new chimpanzee adenovirus isolates, allocated into human adenovirus species E, as well as construction and evaluation of vaccine vectors comprising the nucleic acids encoding variable regions of the chimpanzee hexon and fiber polypeptides. This disclosure is additionally based upon, at least in part, the creation of chimeric adenoviral vectors comprising a human adenovirus backbone and at least one of a chimeric hexon or fiber polypeptide sequences or chimpanzee hexon or fiber polypeptide sequences. The adenoviral vectors are capable of eliciting an immune response and, furthermore, have low seroprevalence in humans. The adenoviral vectors can be formulated for vaccines and used to induce protective immunity against specific antigens of interest.

Various publications, articles and patents are cited or described in the background and throughout the specification; each of these references is herein incorporated by reference in its entirety. Discussion of documents, acts, materials, devices, articles or the like which has been included in the present specification is for the purpose of providing context for the invention. Such discussion is not an admission that any or all of these matters form part of the prior art with respect to any inventions disclosed or claimed.

Unless defined otherwise, all technical and scientific terms used herein have the same meaning as commonly understood to one of ordinary skill in the art to which this invention pertains. Otherwise, certain terms used herein have the meanings as set forth in the specification.

It must be noted that as used herein and in the appended claims, the singular forms "a," "an," and "the" include plural reference unless the context clearly dictates otherwise.

Unless otherwise stated, any numerical values, such as a concentration or a concentration range described herein, are to be understood as being modified in all instances by the term "about." Thus, a numerical value typically includes ±10% of the recited value. For example, a concentration of 1 mg/mL includes 0.9 mg/mL to 1.1 mg/mL. Likewise, a concentration range of 1% to 10% (w/v) includes 0.9% (w/v) to 11% (w/v). As used herein, the use of a numerical range expressly includes all possible subranges, all individual numerical values within that range, including integers within such ranges and fractions of the values unless the context clearly indicates otherwise.

Unless otherwise indicated, the term "at least" preceding a series of elements is to be understood to refer to every element in the series. Those skilled in the art will recognize or be able to ascertain using no more than routine experimentation, many equivalents to the specific embodiments of the invention described herein. Such equivalents are intended to be encompassed by the invention.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers and are intended to be non-exclusive or open-ended. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the conjunctive term "and/or" between multiple recited elements is understood as encompassing both individual and combined options. For instance, where two elements are conjoined by "and/or", a first option refers to the applicability of the first element without the second. A second option refers to the applicability of the second element without the first. A third option refers to the applicability of the first and second elements together. Any one of these options is understood to fall within the meaning, and therefore satisfy the requirement of the term "and/or" as used herein. Concurrent applicability of more than one of the options is also understood to fall within the meaning, and therefore satisfy the requirement of the term "and/or."

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. § 2111.03.

As used herein, "subject" means any animal, preferably a mammal, most preferably a human, to whom will be or has been vaccinated by a method according to an embodiment of the invention. The term "mammal" as used herein, encompasses any mammal. Examples of mammals include, but are not limited to, cows, horses, sheep, pigs, cats, dogs, mice, rats, rabbits, guinea pigs, monkeys, humans, etc., more preferably a human.

The words "right", "left", "lower" and "upper" designate directions in the drawings to which reference is made.

It should also be understood that the terms "about," "approximately," "generally," "substantially" and like terms, used herein when referring to a dimension or characteristic of a component of the preferred invention, indicate that the described dimension/characteristic is not a strict boundary or parameter and does not exclude minor variations therefrom that are functionally the same or similar, as would be understood by one having ordinary skill in the art. At a minimum, such references that include a numerical parameter would include variations that, using mathematical and industrial principles accepted in the art (e.g., rounding, measurement or other systematic errors, manufacturing tolerances, etc.), would not vary the least significant digit.

The terms "identical" or percent "identity," in the context of two or more nucleic acids or polypeptide sequences (e.g., hexon and fiber polypeptides and polynucleotides that encode them), refer to two or more sequences or subsequences that are the same or have a specified percentage of amino acid residues or nucleotides that are the same, when compared and aligned for maximum correspondence, as measured using one of the following sequence comparison algorithms or by visual inspection.

For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally, *Current Protocols in Molecular Biology*, F. M. Ausubel et al., eds., Current Protocols, a joint venture between Greene Publishing Associates, Inc. and John Wiley & Sons, Inc., (1995 Supplement) (Ausubel)).

Examples of algorithms that are suitable for determining percent sequence identity and sequence similarity are the BLAST and BLAST 2.0 algorithms, which are described in Altschul et al. (1990) *J. Mol. Biol.* 215: 403-410 and Altschul et al. (1997) *Nucleic Acids Res.* 25: 3389-3402, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased.

Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89:10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

A further indication that two nucleic acid sequences or polypeptides are substantially identical is that the polypeptide encoded by the first nucleic acid is immunologically cross reactive with the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules hybridize to each other under stringent conditions, as described below.

As used herein, the term "protective immunity" or "protective immune response" means that the vaccinated subject is able to control an infection with the pathogenic agent against which the vaccination was done. The pathogenic agent can, for example, be an antigenic gene product or antigenic protein, or a fragment thereof. Usually, the subject having developed a "protective immune response" develops only mild to moderate clinical symptoms or no symptoms at all. Usually, a subject having a "protective immune response" or "protective immunity" against a certain agent will not die as a result of the infection with said agent.

The term "adjuvant" is defined as one or more substances that cause stimulation of the immune system. In this context, an adjuvant is used to enhance an immune response to the adenovirus vectors of the invention.

As used herein, the term "antigenic gene product or fragment thereof" or "antigenic protein" can include a bacterial, viral, parasitic, or fungal protein, or a fragment thereof. Preferably, an antigenic protein or antigenic gene product is capable of raising in a host a protective immune response, e.g., inducing an immune response against a disease or infection (e.g., a bacterial, viral, parasitic, or fungal disease or infection), and/or producing an immunity in (i.e., vaccinating) a subject against a disease or infection, that protects the subject against the disease or infection.

Adenoviral Vectors

Exposure to certain adenoviruses has resulted in immune responses against certain adenoviral serotypes, which can affect efficacy of adenoviral vectors. Because infections with human adenoviruses are common in humans, the prevalence of neutralizing antibodies against human adenoviruses in human populations is high. The presence of such neutralizing antibodies in individuals may be expected to reduce the efficacy of a gene transfer vector based on a human adenoviral backbone. One way to circumvent the reduction of efficacy is to replace the epitopes on the adenoviral capsid proteins that are the targets of neutralizing antibodies. The target sequences on the capsid proteins can be replaced with protein sequences from other adenoviruses which are of low prevalence, and therefore against which neutralizing antibodies are rare in human populations.

A "capsid protein" refers to a protein on the capsid of an adenovirus (e.g., BB21, BB24, HAdV-4) or a functional fragment or derivative thereof that is involved in determining the serotype and/or tropism of a particular adenovirus. Capsid proteins typically include the fiber, penton and/or hexon proteins. In certain embodiments, the capsid protein is an entire or full length capsid protein of the adenovirus. In other embodiments, the capsid protein is a fragment or a derivative of a full length capsid protein of the adenovirus. In certain embodiments, the hexon, penton and fiber encoded by an adenoviral vector of the invention are of the same or different adenoviral background (i.e., a BB21 hexon and a BB21 fiber, a BB24 hexon and a BB24 fiber, a PrtoAdV-1 hexon and a BB21 fiber variant, a PtroAdV-13 hexon and a BB24 fiber, etc).

A "hexon polypeptide" refers to adenovirus hexon coat proteins, functional fragments, and derivatives thereof.

A "fiber polypeptide" refers to adenovirus fiber proteins, functional fragments, and derivatives thereof.

One target of neutralizing antibodies against adenoviruses is the major coat protein, the hexon protein. Replacing the hexon protein or the variable sequences within the hexon protein, which define serotype and bind to neutralizing antibodies, with the hexon protein or variable sequences within the hexon protein from adenoviruses that are rare in the human population, such as those chimpanzee adenovirus sequences described herein, can allow for the construction of adenovirus vectors that would be less susceptible to neutralization by antibodies commonly found in humans.

A second target of neutralizing antibodies against adenoviruses is the fiber protein. Replacing the fiber protein or variable sequences within the fiber protein with the fiber protein or variable sequences within the fiber protein from adenoviruses that are rare in the human population, such as those chimpanzee adenovirus sequences described herein, can also allow for the construction of adenovirus vectors that would be less susceptible to neutralization by antibodies commonly found in humans. A combination of the fiber replacement with hexon replacements described above can confer additional resistance to neutralization by antibodies commonly present in human populations.

This disclosure provides isolated and chimeric nucleic acid sequences encoding hexon polypeptides and/or fiber polypeptides derived from isolated human and simian adenovirus serotypes and adenoviral vectors comprising at least one of the isolated and/or chimeric nucleic acid sequences.

An "adenoviral vector" refers to a recombinant vector derived from or containing at least a portion of an adenoviral genome.

In preferred embodiments, the isolated nucleic acid sequences encode a fiber polypeptide with at least 98% identity to amino acids 6-375 of SEQ ID NO:2. In certain embodiments, the isolated nucleic acid sequences encode a fiber polypeptide with at least 99% identity to amino acids 6-375 of SEQ ID NO:2. In certain embodiments, the isolated nucleic acid sequences encode a fiber polypeptide with at least 98%, 99% identity to SEQ ID NO:2. The fiber polypeptide can, for example, comprise an amino acid sequence selected from a BB21 fiber polypeptide (SEQ ID NO:2), a BB21 fiber variant polypeptide (SEQ ID NO:3), or a BB24 fiber polypeptide (SEQ ID NO:4). In certain preferred embodiments, the isolated nucleic acid sequence further comprises a nucleic acid sequence encoding a hexon polypeptide comprising a hexon polypeptide hypervariable regions-encompassing polypeptide comprising an amino acid sequence selected from SEQ ID NO:5 or SEQ ID NO:6. The hexon polypeptide can, for example, comprise an amino acid sequence selected from a BB21 hexon polypeptide (SEQ ID NO:7) or a BB24 hexon polypeptide (SEQ ID NO:8).

In preferred embodiments, the isolated nucleic acid sequences encode a hexon polypeptide comprising a polypeptide sequence comprising a hexon polypeptide hypervariable regions-encompassing polypeptide, wherein the hexon hypervariable regions-encompassing polypeptide comprises an amino acid sequence selected from SEQ ID NO:5 or SEQ ID NO:6. In certain embodiments, the hexon polypeptide comprises an amino acid sequence selected from a BB21 hexon polypeptide (SEQ ID NO:7) or a BB24 hexon polypeptide (SEQ ID NO:8).

In preferred embodiments, provided is an isolated nucleic acid comprising a hexon nucleic acid sequence encoding at least one of the hexon polypeptides disclosed herein and a nucleic acid sequence encoding at least one of the fiber polypeptides disclosed herein.

In preferred embodiments, provided are vectors, preferably adenoviral vectors, comprising at least one of an isolated nucleic acid sequence encoding a hexon polypeptide and/or an isolated nucleic acid sequence encoding a fiber polypeptide according to embodiments of the invention. The adenoviral vectors can, for example, comprise at least one transgene insertion site; and a nucleic acid sequence encoding a hexon polypeptide and/or a fiber polypeptide, wherein the hexon polypeptide comprises a polypeptide comprising a hexon polypeptide hypervariable regions-encompassing polypeptide disclosed herein and the fiber polypeptide comprises a fiber polypeptide described herein.

Typically, an adenoviral vector of the invention comprises the entire recombinant adenoviral genome on, e.g., a plasmid, cosmid, or baculovirus vector. The nucleic acid molecules of the invention can be in the form of RNA or in the form of DNA obtained by cloning or produced synthetically. The DNA can be double-stranded or single-stranded.

One of ordinary skill will recognize that elements derived from multiple serotypes can be combined in a single adenoviral vector, for example human or simian adenovirus. Thus, a chimeric adenovirus vector that combines desirable properties from different serotypes can be produced. Thus, in some embodiments, a chimeric adenovirus vector of the invention could combine the absence of pre-existing immunity of a simian hexon and/or fiber polypeptide sequences with the high level antigen delivery and presentation capacity of an existing adenoviral vectors, such as rAd4, rAd5, rAd26 or rAd35.

Advantages of adenoviral vectors for use as vaccines include ease of manipulation, good manufacturability at large scale, and an excellent safety record based on many years of experience in research, development, manufacturing and clinical trials with numerous adenoviral vectors that have been reported. Adenoviral vectors that are used as vaccines generally provide a good immune response to the transgene-encoded protein, including a cellular immune response. An adenoviral vector according to the invention can be based on any type of adenovirus, and in certain embodiments is a human adenovirus, which can be of any group or serotype. In preferred embodiments, the recombinant adenovirus is based upon a human adenovirus from group A, B, C, D, E, F or G. In other preferred embodiments, the recombinant adenovirus is based upon a human adenovirus serotype 5, 11, 26, 34, 35, 48, 49, or 50. In other embodiments, it is a simian adenovirus, such as chimpanzee or gorilla adenovirus, which can be of any serotype. In certain embodiments, the recombinant adenovirus is based upon chimpanzee adenovirus type 1, 3, 7, 8, 21, 22, 23, 24, 25, 26, 27.1, 28.1, 29, 30, 31.1, 32, 33, 34, 35.1, 36, 37.2, 39, 40.1, 41.1, 42.1, 43, 44, 45, 46, 48, 49, 50, 67, or SA7P.

In a more preferred embodiment, the chimpanzee adenovirus vector of the second composition is ChAdV3. Recombinant chimpanzee adenovirus serotype 3 (ChAd3 or cAd3) is a subgroup C adenovirus with properties similar to those of human adenovirus serotype 5 (Ad5). ChAd3 has been shown to be safe and immunogenic in human studies evaluating candidate vaccines for hepatitis C virus (HCV) (Barnes E, et al. 2012 Science translational medicine 4: 115ra1). It was reported that ChAd3-based vaccines were capable of inducing an immune response comparable to a human Ad5 vectored vaccine. See, e.g., Peruzzi D, et al. 2009 Vaccine 27: 1293-300 and Quinn K M, et al. 2013 J Immunol 190: 2720-35; WO 2005/071093; and WO2011/0130627.

Adenoviral vectors, methods for construction thereof and methods for propagating thereof, are well known in the art and are described in, for example, U.S. Pat. Nos. 5,559,099, 5,837,511, 5,846,782, 5,851,806, 5,994,106, 5,994,128, 5,965,541, 5,981,225, 6,040,174, 6,020,191, and 6,113,913, and Thomas Shenk, "Adenoviridae and their Replication", M. S. Horwitz, "Adenoviruses", Chapters 67 and 68, respectively, in Virology, B. N. Fields et al., eds., 3d ed., Raven Press, Ltd., New York (1996), and other references mentioned herein. Typically, construction of adenoviral vectors involves the use of standard molecular biological techniques, such as those described in, for example, Sambrook et al., *Molecular Cloning, a Laboratory Manual*, 2d ed., Cold Spring Harbor Press, Cold Spring Harbor, N.Y. (1989), Watson et al., *Recombinant DNA*, 2d ed., *Scientific American Books* (1992), and Ausubel et al., *Current Protocols in Molecular Biology*, Wiley Interscience Publishers, NY (1995), and other references mentioned herein.

In certain embodiments, the adenoviral vector comprises an E1 deletion and/or an E3 deletion. An E1 or E3 deletion can, for example, include a complete deletion of the gene or a partial deletion, which renders the E1 or E3 gene product functionally defective. Thus, in certain embodiments, the adenovirus is replication deficient, e.g. because it contains a deletion in the E1 region of the genome. As known to the skilled person, in case of deletions of essential regions from the adenovirus genome, the functions encoded by these regions have to be provided in trans, preferably by the producer cell, i.e. when parts or whole of E1, E2 and/or E4 regions are deleted from the adenovirus, these have to be present in the producer cell, for instance integrated in the genome thereof, or in the form of so-called helper adenovirus or helper plasmids. The adenovirus may also have a deletion in the E3 region, which is dispensable for replication, and hence such a deletion does not have to be complemented. One or more of the E1, E2, E3 and E4 regions can also be inactivated by other means, such as by inserting a transgene of interest (usually linked to a promoter) into the regions to be inactivated.

A producer cell (sometimes also referred to in the art and herein as 'packaging cell' or 'complementing cell') that can be used can be any producer cell wherein a desired adenovirus can be propagated. For example, the propagation of recombinant adenovirus vectors is done in producer cells that complement deficiencies in the adenovirus. Such producer cells preferably have in their genome at least an adenovirus E1 sequence, and thereby are capable of complementing recombinant adenoviruses with a deletion in the E1 region. Any E1-complementing producer cell can be used, such as human retina cells immortalized by E1, e.g. 911 or PER.C6 cells (see U.S. Pat. No. 5,994,128), E1-transformed amniocytes (See EP patent 1230354), E1-transformed A549 cells (see e.g. WO 98/39411, U.S. Pat. No. 5,891,690), GH329:HeLa (Gao et al., 2000, *Hum Gene Ther* 11: 213-19), 293, and the like. In certain embodiments, the producer cells are for instance HEK293 cells, or PER.C6 cells, or 911 cells, or IT293SF cells, and the like. Production of adenoviral vectors in producer cells is reviewed in (Kovesdi et al., 2010, *Viruses* 2: 1681-703).

In certain embodiments, the adenoviral vector is a chimeric adenoviral vector comprising one or more human adenoviral nucleic acid sequences. The human adenoviral nucleic acids can, for example, be selected from human adenovirus-4 (Ad-4), human adenovirus-5 (Ad-5), human adenovirus-26 (Ad-26), or human adenovirus-35 (Ad-35). In certain embodiments, an E1-deficient adenoviral vector comprises the E4-orf6 coding sequence of an adenovirus of human Ad5. This allows propagation of such adenoviruses in well-known complementing cell lines that express the E1 genes of Ad5, such as for example 293 cells or PER.C6 cells (see, e.g. Fallaux et al., 1998, *Hum Gene Ther* 9: 1909-17, Havenga et al., 2006, *J Gen Virol* 87: 2135-43; WO 03/104467, incorporated in their entirety by reference herein).

In certain embodiments, the adenoviral vector comprises a transgene. A "transgene" refers to a heterologous nucleic acid, which is a nucleic acid that is not naturally present in the vector, and according to the present invention the transgene can encode an antigenic gene product or antigenic protein that elicits an immune response in the subject. The transgene can, for example, be introduced into the vector by standard molecular biology techniques. The transgene can, for example, be cloned into a deleted E1 or E3 region of an adenoviral vector, or in the region between the E4 region and the rITR. A transgene is generally operably linked to expression control sequences. In preferred embodiments, the transgene is inserted at a transgene insertion site.

If required, the nucleic acid sequence encoding a hexon or fiber polypeptide according to embodiments of the invention, and/or the transgene can be codon-optimized to ensure proper expression in the treated host (e.g., human). Codon-optimization is a technology widely applied in the art.

The transgene can be under the control of (i.e., operably linked to) an adenovirus-derived promoter (e.g., the Major Late Promoter) or can be under the control of a heterologous promoter. Examples of suitable heterologous promoters include the CMV promoter and the RSV promoter. Preferably, the promoter is located upstream of the heterologous gene of interest within an expression cassette.

In preferred embodiments, the adenoviral vector comprises a nucleic acid sequence selected from the group consisting of SEQ ID NO:28, SEQ ID NO:29, SEQ ID NO:30, SEQ ID NO:31, SEQ ID NO:53, and SEQ ID NO:57.

Immunogenic Compositions

Immunogenic compositions are compositions comprising an immunologically effective amount of purified or partially purified human or simian (e.g., chimpanzee) adenovirus vectors for use in the invention. Said compositions can be formulated as a vaccine (also referred to as an "immunogenic composition") according to methods well known in the art. Such compositions can include adjuvants to enhance immune responses. The optimal ratios of each component in the formulation can be determined by techniques well known to those skilled in the art in view of the present disclosure.

The immunogenic compositions according to embodiments of the present invention can be made using methods known to those of skill in the art in view of the present disclosure. Liquid pharmaceutical compositions generally include a liquid carrier such as water, petroleum, animal or vegetable oils, mineral oil or synthetic oil. Physiological saline solution, dextrose or other saccharide solution or glycols such as ethylene glycol, propylene glycol or polyethylene glycol can be included.

The immunogenic compositions useful in the invention can comprise adjuvants. Adjuvants suitable for co-administration in accordance with the invention should be ones that are potentially safe, well tolerated and effective in people including QS-21, Detox-PC, MPL-SE, MoGM-CSF, TiterMax-G, CRL-1005, GERBU, TERamide, PSC97B, Adjumer, PG-026, GSK-I, AS01, AS03, AS04, AS15, GcMAF, B-alethine, MPC-026, Adjuvax, CpG ODN, Betafectin, Alum, and MF59.

Other adjuvants that can be administered include lectins, growth factors, cytokines and lymphokines such as alpha-interferon, gamma interferon, platelet derived growth factor (PDGF), granulocyte-colony stimulating factor (gCSF), granulocyte macrophage colony stimulating factor (gMCSF), tumor necrosis factor (TNF), epidermal growth factor (EGF), IL-I, IL-2, IL-4, IL-6, IL-8, IL-10, and IL-12 or encoding nucleic acids therefore.

The compositions of the invention can comprise a pharmaceutically acceptable excipient, carrier, buffer, stabilizer or other materials well known to those skilled in the art. Such materials should be non-toxic and should not interfere with the efficacy of the active ingredient. The precise nature of the carrier or other material can depend on the route of administration, e.g., intramuscular, subcutaneous, oral, intravenous, cutaneous, intramucosal (e.g., gut), intranasal or intraperitoneal routes.

Method for Inducing Protective Immunity

Another general aspect of the invention relates to a method of inducing an immune response in a subject in need thereof. The methods can, for example, comprise administering to the subject a vaccine comprising an adenoviral vector described herein and a pharmaceutically acceptable carrier. Also provided herein are methods of producing a vaccine. The methods comprise combining an adenoviral vector described herein with a pharmaceutically acceptable carrier.

Any of the immunogenic compositions according to embodiments of the invention, including but not limited to those described herein, can be used in methods of the invention as a vaccine.

Administration of the immunogenic compositions/vaccines comprising the vectors is typically intramuscular or subcutaneous. However other modes of administration such as intravenous, cutaneous, intradermal, genital, or nasal can be envisaged as well. Intramuscular administration of the immunogenic compositions can be achieved by using a needle to inject a suspension of the adenovirus vector. An alternative is the use of a needleless injection device to administer the composition (using, e.g., Biojector™) or a freeze-dried powder containing the vaccine.

For intravenous, cutaneous or subcutaneous injection, or injection at the site of affliction, the vector will be in the form of a parenterally acceptable aqueous solution which is pyrogen-free and has suitable pH, isotonicity and stability. Those of skill in the art are well able to prepare suitable solutions using, for example, isotonic vehicles such as Sodium Chloride Injection, Ringer's Injection, Lactated Ringer's Injection. Preservatives, stabilizers, buffers, antioxidants and/or other additives can be included, as required. A slow-release formulation can also be employed.

Typically, administration will have a prophylactic aim to generate an immune response against an antigen of interest (e.g., a bacterial, viral, parasitic, and/or fungal pathogen) before infection or development of symptoms. Diseases and disorders that can be treated or prevented in accordance with the invention include those in which an immune response can play a protective or therapeutic role. In other embodiments, the adenovirus vectors can be administered for post-exposure prophylactics.

The immunogenic compositions containing the human or simian (e.g., chimpanzee) adenovirus vectors are administered to a subject, giving rise to an immune response to the antigen of interest in the subject. An amount of a composition sufficient to induce a detectable immune response is defined to be an "immunologically effective dose" or an "effective amount" of the composition. The immunogenic compositions of the invention can induce a humoral as well as a cell-mediated immune response. In a typical embodiment the immune response is a protective immune response.

The actual amount administered, and rate and time-course of administration, will depend on the nature and severity of what is being treated. Prescription of treatment, e.g., decisions on dosage etc., is within the responsibility of general practitioners and other medical doctors, or in a veterinary context a veterinarian, and typically takes account of the disorder to be treated, the condition of the individual patient, the site of delivery, the method of administration and other factors known to practitioners. Examples of the techniques and protocols mentioned above can be found in Remington's Pharmaceutical Sciences, 16th edition, Osol, A. ed., 1980.

Following production of adenovirus vectors and optional formulation of such particles into compositions, the vectors can be administered to an individual, particularly human or other primate. Administration can be to humans, or another mammal, e.g., mouse, rat, hamster, guinea pig, rabbit, sheep, goat, pig, horse, cow, donkey, monkey, dog or cat. Delivery to a non-human mammal need not be for a therapeutic purpose, but can be for use in an experimental context, for instance in investigation of mechanisms of immune responses to the adenovirus vectors.

In one exemplary regimen, the adenoviral vector is administered (e.g., intramuscularly) in a volume ranging between about 100 µl to about 10 ml containing concentrations of about $10^4$ to $10^{12}$ virus particles/ml. Preferably, the adenoviral vector is administered in a volume ranging between 0.1 and 2.0 ml. For example, the adenoviral vector can be administered with 100 µl, 500 µl, 1 ml, 2 ml. More preferably the adenoviral vector is administered in a volume of 0.5 ml. Optionally, the adenoviral vector can be administered in a concentration of about $10^7$ vp/ml, $10^8$ vp/ml, $10^9$ vp/ml, $10^{10}$ vp/ml, $5\times10^{10}$ vp/ml, $10^{11}$ vp/ml, or $10^{12}$ vp/ml. Typically, the adenoviral vector is administered in an amount of about $10^9$ to about $10^{12}$ viral particles (vp) to a human subject during one administration, more typically in an amount of about $10^{10}$ to about $10^{12}$ vp.

The initial vaccination can be followed by a boost or a kick from a vaccine/composition comprising the same adenoviral vector encoding an antigen of interest or a vaccine/composition comprising a different adenoviral vector encoding the same antigen of interest.

The composition can, if desired, be presented in a kit, pack or dispenser, which can contain one or more unit dosage forms containing the active ingredient. The kit, for example, can comprise metal or plastic foil, such as a blister pack. The kit, pack, or dispenser can be accompanied by instructions for administration.

The compositions of the invention can be administered alone or in combination with other treatments, either simultaneously or sequentially dependent upon the condition to be treated.

EMBODIMENTS

The invention provides also the following non-limiting embodiments.

Embodiment 1 is an isolated nucleic acid sequence encoding a fiber polypeptide with at least 98% identity to amino acids 6-375 of SEQ ID NO:2.

Embodiment 2 is the isolated nucleic acid sequence of embodiment 1, wherein the fiber polypeptide comprises an amino acid sequence selected from a BB21 fiber polypeptide (SEQ ID NO:2), a BB21 fiber variant polypeptide (SEQ ID NO:3), or a BB24 fiber polypeptide (SEQ ID NO:4).

Embodiment 3 is an isolated nucleic acid of embodiment 1 or 2, wherein the isolated nucleic acid further comprises a nucleic acid sequence encoding a hexon polypeptide comprising a hexon hypervariable regions-encompassing polypeptide comprising an amino acid sequence selected from SEQ ID NO:5 or SEQ ID NO:6.

Embodiment 4 is the isolated nucleic acid of embodiment 3, wherein the hexon polypeptide comprises an amino acid sequence selected from a BB21 hexon polypeptide (SEQ ID NO:7) or a BB24 hexon polypeptide (SEQ ID NO:8).

Embodiment 5 is an isolated nucleic acid of embodiment 1 or 2, wherein the isolated nucleic acid further comprises a nucleic acid sequence encoding a hexon polypeptide comprising an amino acid sequence selected from a Ptr01 hexon polypeptide (SEQ ID NO:10) or a Ptr13 hexon polypeptide (SEQ ID NO:12).

Embodiment 6 is an isolated nucleic acid sequence encoding a hexon polypeptide comprising a hexon hypervariable regions-encompassing polypeptide comprising an amino acid sequence selected from SEQ ID NO:5 or SEQ ID NO:6.

Embodiment 7 is the isolated nucleic acid sequence of embodiment 6, wherein the hexon polypeptide comprises an amino acid sequence selected from a BB21 hexon polypeptide (SEQ ID NO:7) or a BB24 hexon polypeptide (SEQ ID NO:8).

Embodiment 8 is a vector comprising the nucleic acid of any one of embodiments 1-7.

Embodiment 9 is the vector of embodiment 8, being an adenoviral vector, and further comprising a transgene.

Embodiment 10 is a recombinant cell comprising the vector of embodiment 8 or 9.

Embodiment 11 is a method of producing a vector, comprising (a) growing the recombinant cell of embodiment 10 under conditions for production of the vector;

and (b) isolating the vector from the recombinant cell.

Embodiment 12 is an immunogenic composition comprising the vector of embodiment 8 or 9.

Embodiment 13 is a method of inducing an immune response in a subject in need thereof, comprising administering to the subject the immunogenic composition of embodiment 12.

Embodiment 14 is an adenoviral vector comprising (a) at least one transgene; and (b) a nucleic acid sequence encoding a fiber polypeptide, wherein the fiber polypeptide comprises an amino acid sequence with at least 98% identity to amino acids 6-375 of SEQ ID NO:2.

Embodiment 15 is the adenoviral vector of embodiment 14, wherein the fiber polypeptide comprises an amino acid sequence with at least 99% identity to amino acids 6-375 of SEQ ID NO:2.

Embodiment 16 is the adenoviral vector of embodiment 14 or 15, wherein the fiber polypeptide comprises an amino acid sequence with at least 98% identity to SEQ ID NO:2.

Embodiment 17 is the adenoviral vector of any one of embodiments 14-16, wherein the fiber polypeptide comprises an amino acid sequence with at least 99% identity to SEQ ID NO:2.

Embodiment 18 is the adenoviral vector of any one of embodiments 14-17, wherein the fiber polypeptide comprises an amino acid sequence selected from a BB21 fiber polypeptide (SEQ ID NO:2), a BB21 fiber variant polypeptide (SEQ ID NO:3), or a BB24 fiber polypeptide (SEQ ID NO:4).

Embodiment 19 is the adenoviral vector of any one of embodiments 14-18, further comprising a nucleic acid sequence encoding a hexon polypeptide comprising a hexon hypervariable regions-encompassing polypeptide comprising an amino acid sequence selected from SEQ ID NO:5 or SEQ ID NO:6.

Embodiment 20 is the adenoviral vector of embodiment 19, wherein the hexon polypeptide comprises an amino acid sequence selected from a BB21 hexon polypeptide (SEQ ID NO:7) or a BB24 hexon polypeptide (SEQ ID NO:8).

Embodiment 21 is an adenoviral vector comprising (a) at least one transgene insertion site; and (b) a nucleic acid sequence encoding a hexon polypeptide, wherein the hexon polypeptide comprises a hexon hypervariable regions-encompassing polypeptide comprising an amino acid sequence selected from SEQ ID NO:5 or SEQ ID NO:6.

Embodiment 22 is the adenoviral vector of embodiment 21, wherein the hexon polypeptide comprises an amino acid sequence selected from a BB21 hexon polypeptide (SEQ ID NO:7) or a BB24 hexon polypeptide (SEQ ID NO:8).

Embodiment 23 is the adenoviral vector of any one of embodiments 14-22, wherein the adenoviral vector further comprises an E1 deletion or an inactivated E1.

Embodiment 24 is the adenoviral vector of any one of embodiments 14-23, wherein the adenoviral vector further comprises an E3 deletion or an inactivated E3.

Embodiment 25 is the adenoviral vector of any one of embodiments 14-24, wherein the adenoviral vector is a chimeric adenoviral vector comprising one or more human adenoviral nucleic acid sequences.

Embodiment 26 is the adenoviral vector of embodiment 25, wherein the human adenoviral nucleic acid sequences are from human adenovirus-4 (hAdV-4), human adenovirus-5 (hAdV-5), human adenovirus-26 (hAdV-26), or human adenovirus-35 (hAdV-35).

Embodiment 27 is the adenoviral vector of embodiment 26, wherein the adenoviral vector comprises a human adenovirus-5 (hAdV-5) E4 orf6.

Embodiment 28 is the adenoviral vector of any one or embodiments 14-27, wherein the transgene insertion site is adjacent to an inverted terminal repeat (ITR).

Embodiment 29 is the adenoviral vector of embodiment 28, wherein a transgene is inserted at one or more transgene insertion sites selected from the group consisting of a transgene insertion site at the E1 deletion, a transgene insertion site at the E3 deletion, and the transgene insertion site adjacent to the ITR.

Embodiment 30 is the adenoviral vector of any one of embodiments 14-29, wherein the adenoviral vector comprises a nucleic acid sequence selected from the group consisting of SEQ ID NO:28, SEQ ID NO:29, SEQ ID NO:30, and SEQ ID NO:31.

Embodiment 31 is the adenoviral vector of any one of embodiments 14-18 and 23-29, wherein the adenoviral vector comprises a nucleic acid sequence selected from SEQ ID NO:53 or SEQ ID NO:57.

Embodiment 32 is an adenoviral vector comprising (a) at least one transgene; (b) a nucleic acid sequence encoding a hexon polypeptide comprising an amino acid sequence selected from the group consisting of BB21 hexon polypeptide (SEQ ID NO:7), a BB24 hexon polypeptide (SEQ ID NO:8), a Ptr01 hexon polypeptide (SEQ ID NO:10), a Ptr13 hexon polypeptide (SEQ ID NO:12), and (c) a nucleic acid sequence encoding a fiber polypeptide comprising an amino acid sequence selected from a BB21 fiber polypeptide (SEQ ID NO:2), a BB21 fiber variant polypeptide (SEQ ID NO:3), or a BB24 fiber polypeptide (SEQ ID NO:4).

Embodiment 33 is the adenoviral vector of embodiment 32, wherein the hexon polypeptide comprises the amino acid sequence of a Ptr01 hexon polypeptide (SEQ ID NO:10) or a Ptr13 hexon polypeptide (SEQ ID NO:12), and the fiber polypeptide comprises the amino acid sequence of a BB21 fiber polypeptide (SEQ ID NO:2), a BB21 fiber variant polypeptide (SEQ ID NO:3), or a BB24 fiber polypeptide (SEQ ID NO:4).

Embodiment 34 is the adenoviral vector of embodiment 33, wherein the hexon polypeptide comprises the amino acid sequence of the Ptr01 hexon polypeptide (SEQ ID NO:10) and the fiber polypeptide comprises the amino acid sequence of the BB24 fiber polypeptide (SEQ ID NO:4).

Embodiment 35 is the adenoviral vector of embodiment 33, wherein the hexon polypeptide comprises the amino acid sequence of the Ptr13 hexon polypeptide (SEQ ID NO:12) and the fiber polypeptide comprises the amino acid sequence of the BB21 fiber variant polypeptide (SEQ ID NO:3).

Embodiment 36 is the adenoviral vector of embodiment 32, wherein the hexon polypeptide comprises the amino acid sequence of a BB21 hexon polypeptide (SEQ ID NO:7), and the fiber polypeptide comprises the amino acid sequence of a BB21 fiber polypeptide (SEQ ID NO:2).

Embodiment 37 is the adenoviral vector of embodiment 32, wherein the hexon polypeptide comprises the amino acid sequence of a BB24 hexon polypeptide (SEQ ID NO:8), and the fiber polypeptide comprises the amino acid sequence of a BB24 fiber polypeptide (SEQ ID NO:4).

Embodiment 38 is the adenoviral vector of any of embodiments 32-37, wherein the adenoviral vector further comprises one or more nucleic acid sequences from human adenovirus-4 (HAdV-4), human adenovirus-5 (HAdV-5), human adenovirus-26 (HAdV-26), or human adenovirus-35 (HAdV-35).

Embodiment 39 is the adenoviral vector of embodiment 38, wherein the adenoviral vector comprises one or more nucleic acid sequences from human adenovirus-4 (HAdV-4) and a nucleic acid sequence of a human adenovirus-5 (HAdV-5) E4 orf6.

Embodiment 40 is the adenoviral vector of embodiment 39, comprising the nucleic acid sequence selected from the group consisting of SEQ ID NO:53 and SEQ ID NO:57.

Embodiment 41 is a vaccine comprising an adenoviral vector according to any of embodiments 14-40 and a pharmaceutically acceptable carrier.

Embodiment 42 is a method for inducing an immune response in a subject in need thereof, the method comprising administering to the subject the vaccine of embodiment 41.

Embodiment 43 is a method of producing a vaccine, comprising combining an adenoviral vector according to any of embodiment 14-40 with a pharmaceutically acceptable carrier.

Embodiment 44 is an isolated hexon polypeptide comprising a hexon hypervariable regions-encompassing polypeptide comprising an amino acid sequence selected from SEQ ID NO:5 or SEQ ID NO:6.

Embodiment 45 is the isolated hexon polypeptide of embodiment 44, wherein the hexon polypeptide comprises an amino acid sequence selected from a BB21 hexon polypeptide (SEQ ID NO:7) or a BB24 hexon polypeptide (SEQ ID NO:8).

Embodiment 46 is an isolated hexon polypeptide comprising an amino acid sequence selected from a Ptr01 hexon polypeptide (SEQ ID NO:10) or a Ptr13 hexon polypeptide (SEQ ID NO:12).

Embodiment 47 is an isolated fiber polypeptide, wherein the fiber polypeptide has at least 98% identity to amino acids 6-375 of SEQ ID NO:2.

Embodiment 48 is the isolated fiber polypeptide of embodiment 47, wherein the fiber polypeptide has at least 99% identity to amino acids 6-375 of SEQ ID NO:2.

Embodiment 49 is an isolated fiber polypeptide, wherein the fiber polypeptide has at least 98% identity to SEQ ID NO:2.

Embodiment 50 is the isolated fiber polypeptide of embodiment 49, wherein the fiber polypeptide has at least 99% identity to SEQ ID NO:2.

Embodiment 51 is the isolated fiber polypeptide of embodiment 49, wherein the fiber polypeptide comprises an amino acid sequence selected from a BB21 fiber polypeptide (SEQ ID NO:2), a BB21 fiber variant polypeptide (SEQ ID NO:3), or a BB24 fiber polypeptide (SEQ ID NO:4).

Embodiment 52 is the vaccine of embodiment 41 for inducing an immune response in a subject in need thereof.

Embodiment 53 is use of the vaccine of embodiment 41 for the manufacture of a medicament for inducing an immune response in a subject in need thereof.

Embodiment 54 is an adenoviral vector, wherein the adenoviral vector comprises a nucleic acid sequence selected from the group consisting of SEQ ID NO:40, SEQ ID NO:41, SEQ ID NO:48, SEQ ID NO:49, SEQ ID NO:54, SEQ ID NO:55, SEQ ID NO:58, and SEQ ID NO:59.

Embodiment 55 is the adenoviral vector of embodiment 54, wherein the adenoviral vector comprises a nucleic acid sequence of SEQ ID NO:40.

Embodiment 56 is the adenoviral vector of embodiment 54, wherein the adenoviral vector comprises a nucleic acid sequence of SEQ ID NO:41.

Embodiment 57 is the adenoviral vector of embodiment 54, wherein the adenoviral vector comprises a nucleic acid sequence of SEQ ID NO:48.

Embodiment 58 is the adenoviral vector of embodiment 54, wherein the adenoviral vector comprises a nucleic acid sequence of SEQ ID NO:49.

Embodiment 59 is the adenoviral vector of embodiment 54, wherein the adenoviral vector comprises a nucleic acid sequence of SEQ ID NO:54.

Embodiment 60 is the adenoviral vector of embodiment 54, wherein the adenoviral vector comprises a nucleic acid sequence of SEQ ID NO:55.

Embodiment 61 is the adenoviral vector of embodiment 54, wherein the adenoviral vector comprises a nucleic acid sequence of SEQ ID NO:58.

Embodiment 62 is the adenoviral vector of embodiment 54, wherein the adenoviral vector comprises a nucleic acid sequence of SEQ ID NO:59.

EXAMPLES

Example 1: Generation of E1- and E3-Deleted Vectors Based on Novel Adenovirus Isolates BB21 and BB24

Figure 15:
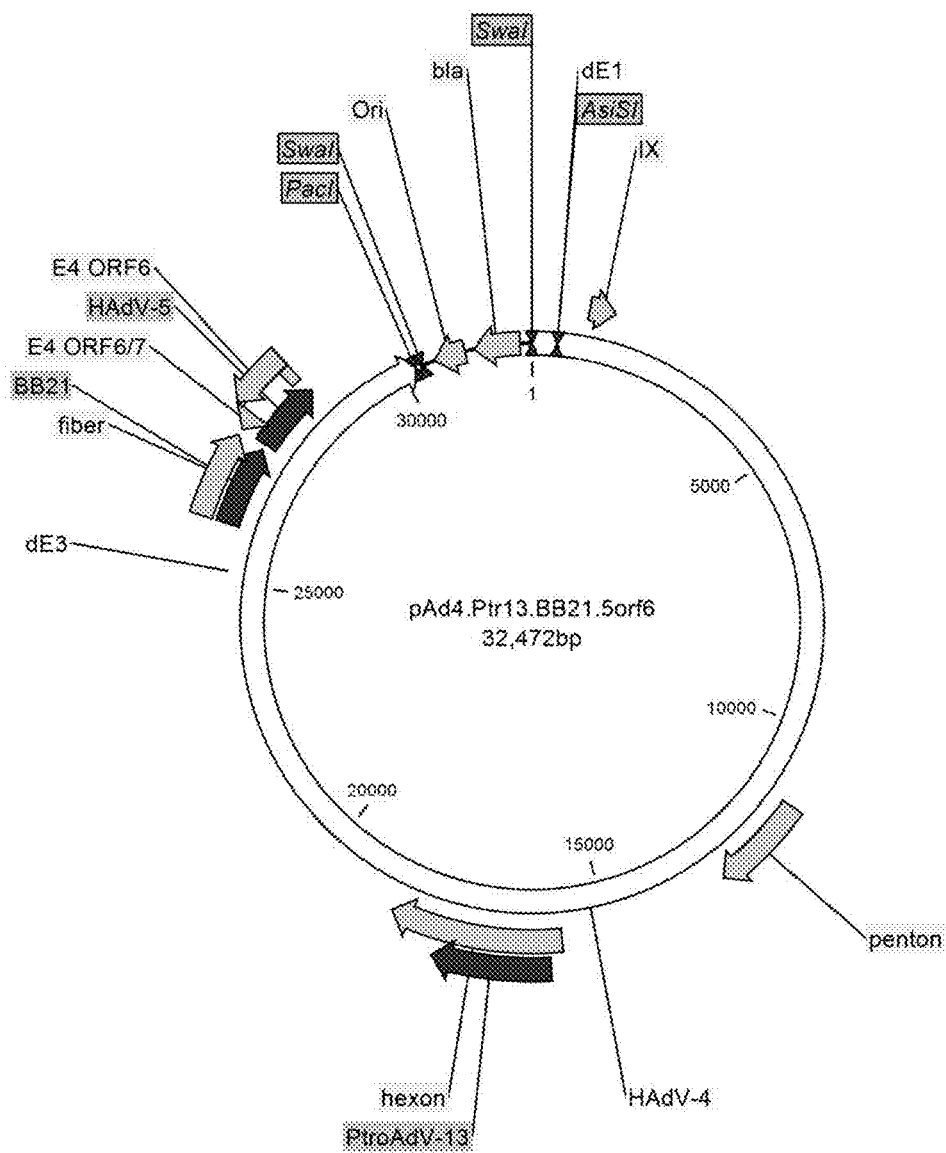
FIG. 15 shows a schematic of the plasmid pAd4.Ptr13.BB21.5orf6 (SEQ ID NO:24).

Two novel chimpanzee adenovirus isolates, BB21 (also designated JAd2-WT) and BB24 (also designated JAd3-WT), were identified and sequenced. The chimpanzee adenovirus isolates were found to phylogenetically belong to the human adenovirus species E (HAdV-E) group. The full genome nucleotide sequence of BB21 and BB24 were determined to be SEQ ID NO:13 and SEQ ID NO:14, respectively. The BB21 hexon and fiber polypeptide sequences were determined to be SEQ ID NOs:7 and 2, respectively. The BB24 hexon and fiber polypeptide sequences were determined to be SEQ ID NOs:8 and 4, respectively. An alignment of the BB21 and BB24 fiber polypeptide sequences is provided in FIG. 15.

Figure 9:
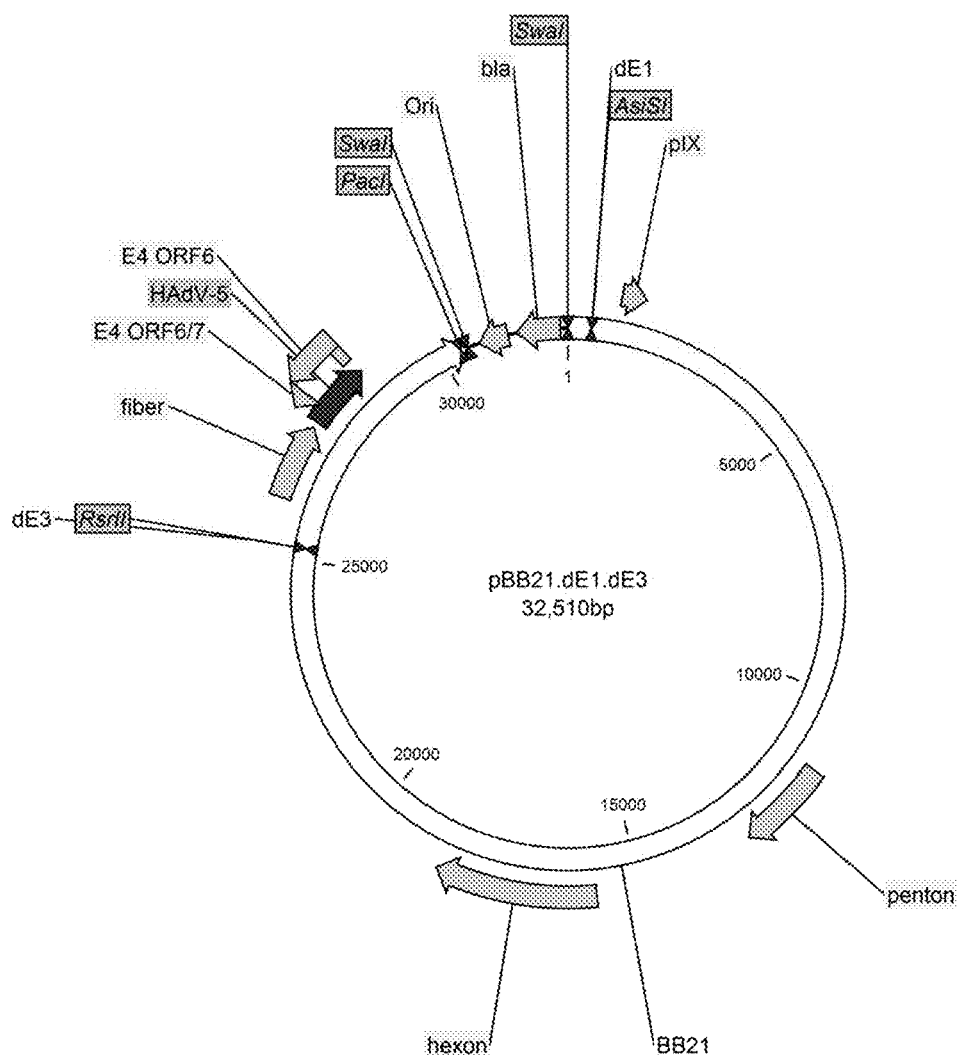
FIG. 9 shows a schematic of the plasmid pBB21.dE1.dE3 (SEQ ID NO:15).
Figure 10:
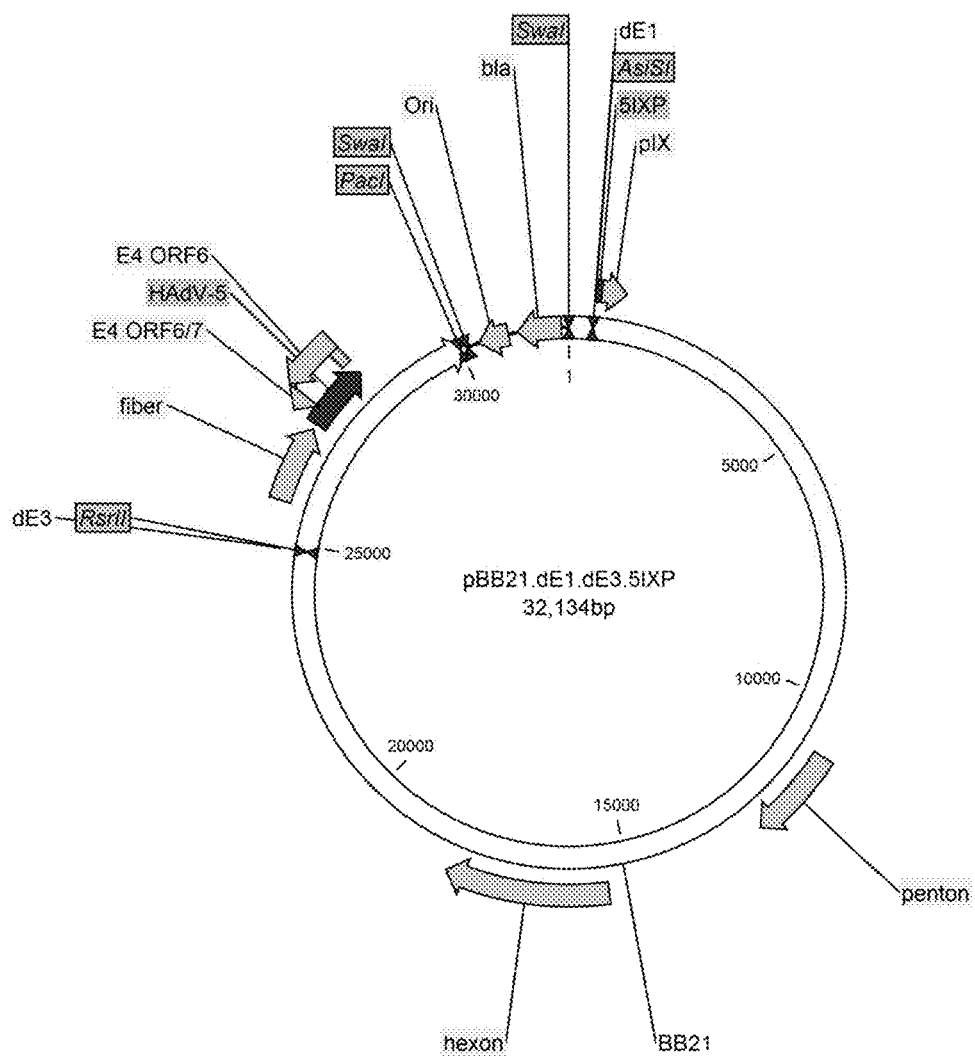
FIG. 10 shows a schematic of the plasmid pBB21.dE1.dE3.5IXP (SEQ ID NO:16).
Figure 11:
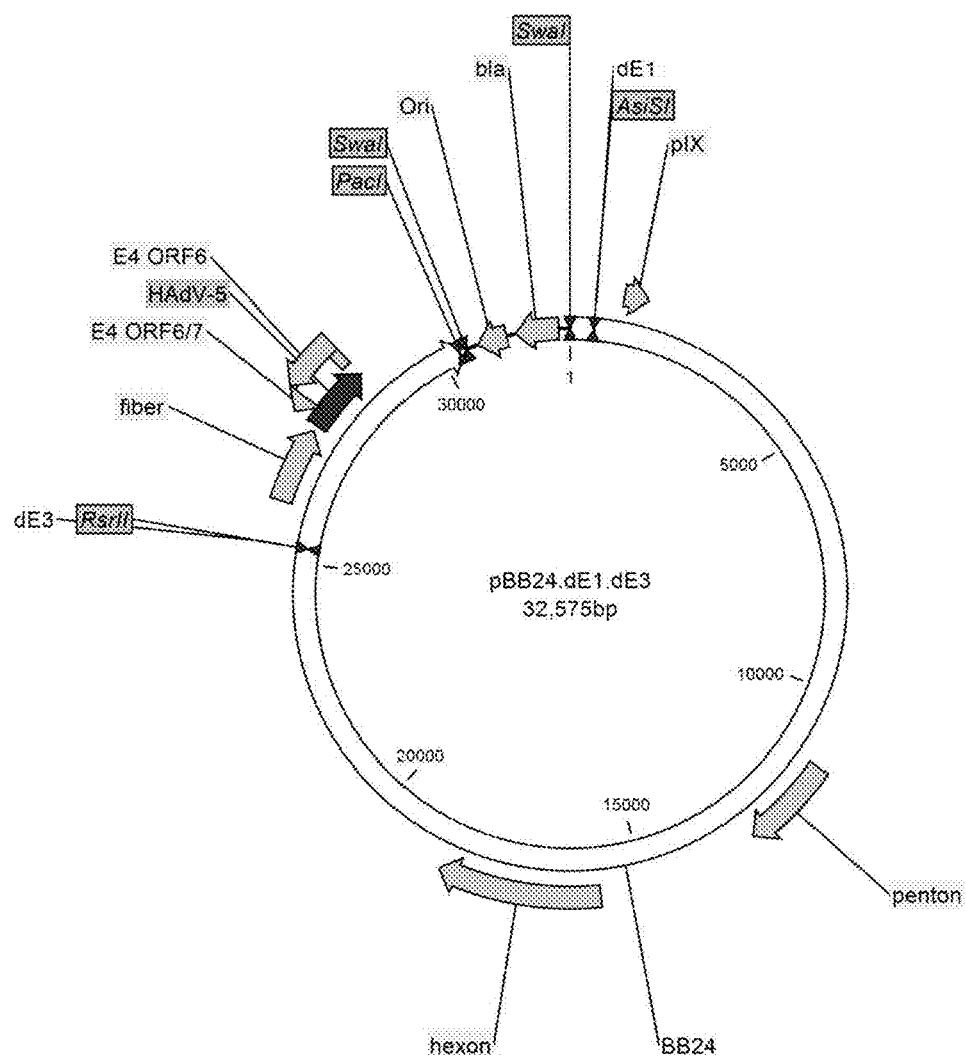
FIG. 11 shows a schematic of the plasmid pBB24.dE1.dE3 (SEQ ID NO:17).
Figure 12:
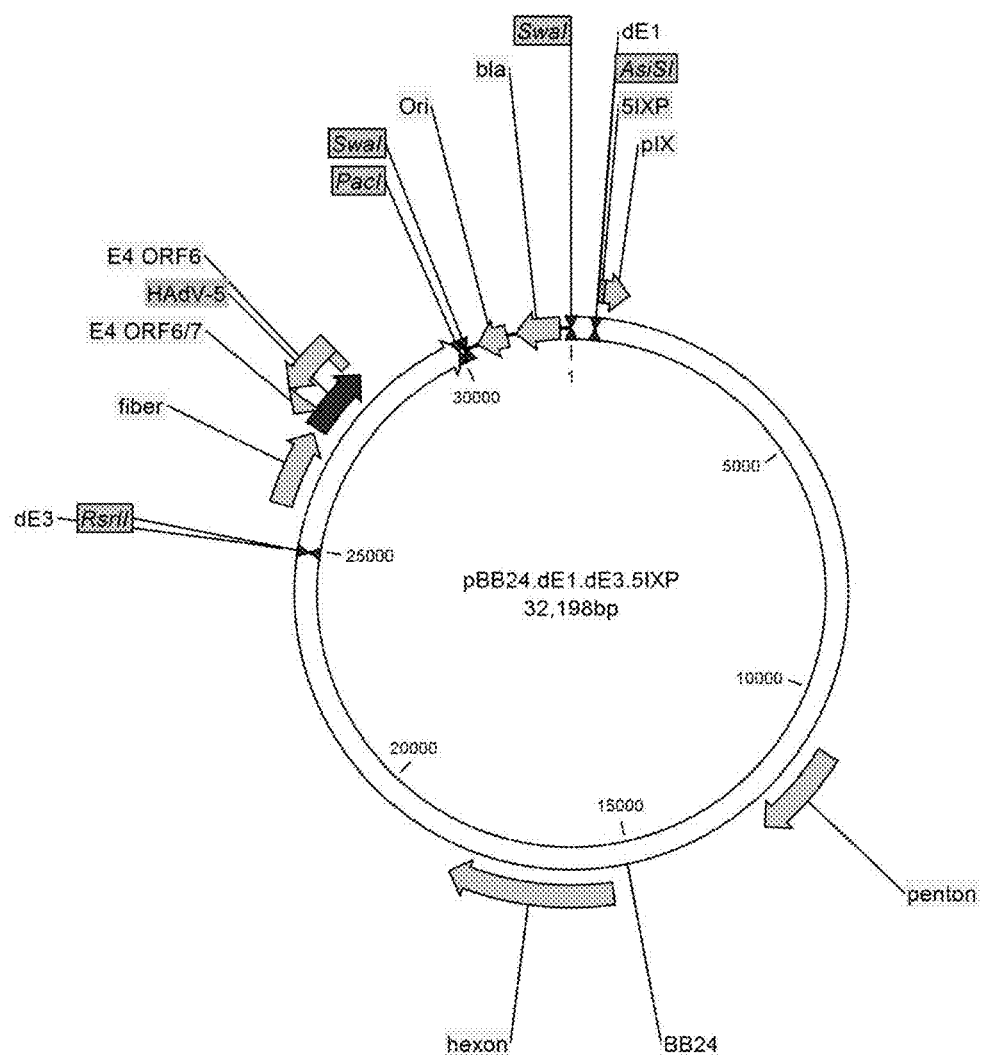
FIG. 12 shows a schematic of the plasmid pBB24.dE1.dE3.5IXP (SEQ ID NO:18).

Description of the Single Plasmid Systems Used for the Generation of BB21- and BB24-Based Ad Vectors pBB21.dE1.dE3 (SEQ ID NO:15; FIG. 9), pBB21.dE1.dE3.5IXP (SEQ ID NO:16; FIG. 10), pBB24.dE1.dE3 (SEQ ID NO:17; FIG. 11), and pBB24.dE1.dE3.5IXP (SEQ ID NO:18; FIG. 12) are plasmids carrying full-length, E1- and E3-deleted adenoviral vector genomes based on isolates BB21 and BB24. The Ad vector genome sequences contained within these plasmids are set forth in SEQ ID NO:28, SEQ ID NO:29, SEQ ID NO:30, and SEQ ID NO:31, respectively. Within each of these plasmids, the adenoviral vector genome is flanked by two SwaI restriction enzyme sites (i.e. one SwaI site is located at either end of the vector genome). These SwaI sites are meant to facilitate excision of the Ad vector genome from the plasmid backbone prior to viral rescue by transfection of suitable E1-complementing cells (such as HEK293, 911, and PER.C6 cells). The Ad vector genomes comprised by these plasmids further carry certain restriction enzyme sites introduced in the location of the E1 deletion, in the E3 deletion, and adjacent to the right inverted terminal repeat (RITR). These restriction enzyme sites were selected to be unique in the context of the complete Ad genome plasmids. They represent "transgene insertion sites" that allow for the facile construction, by standard molecular cloning techniques, of Ad vectors carrying one or more transgene expression cassettes inserted at any of said respective locations or any combinations thereof. Ad vector designs and plasmid constructions are described in more detail in the sections below.

BB21- and BB24-Based Ad Vector Genome Design

The BB21- and BB24-based Ad vector genomes were each designed to comprise an E1 deletion, an E3 deletion, different transgene insertion sites, and a replacement of the native E4 open reading frame (orf) 6 and orf6/7 with that of human adenovirus-5 (HAdV-5). The E1 region of each adenovirus was deleted and replaced with a transgene insertion site comprising an AsiSI restriction enzyme site sequence. The E3 region of each adenovirus was deleted and replaced with a transgene insertion site comprising an RsrII restriction enzyme site sequence. Another transgene insertion site was created by insertion of a PacI restriction enzyme site sequence adjacent to the inverted terminal repeat (ITR) of each adenovirus. The BB21 and BB24 sequences comprising E4 orf6 and orf6/7 coding sequences were replaced by SEQ ID NO:32 and SEQ ID NO:42, respectively. These replacing sequences comprise the E4 orf6 and orf6/7 coding sequences of human adenovirus-5 (HAdV-5) (base pairs 32914-34077 of GenBank sequence AC_000008) modified to carry one silent mutation eliminating a certain AseI site (for cloning purposes).

Two types of E1 region deletions were designed and constructed. The BB21- and BB24-based Ad vector genomes respectively comprised by pBB21.dE1.dE3 and pBB24.dE1.dE3 carry an E1 region deletion corresponding to removal of, respectively, nucleotides 456 to 3027 of SEQ ID NO:13 and nucleotides 457 to 3025 of SEQ ID NO:14. By contrast, the BB21- and BB24-based Ad vector genomes respectively comprised by pBB21.dE1.dE3.5IXP and pBB24.dE1.dE3.5IXP carry a larger E1 region-comprising sequence deletion that removes all the E1 coding sequences of BB21 or BB24 (i.e. nucleotides 456 to 3418 of SEQ ID NO:13 or nucleotides 457 to 3420 of SEQ ID NO:14, respectively). These latter two Ad vector genomes were additionally designed to carry a replacement of the non-coding sequence stretch between E1B 55K and pIX coding sequences by that of HAdV-5 (i.e. sequences corresponding to nucleotides 3419 to 3502 of SEQ ID NO:13 or 3421 to 3504 of SEQ ID NO:14 were replaced by nucleotides 3510-3608 of GenBank AC_000008 (i.e. by SEQ ID NO:27)).

Construction of Single Plasmids Comprising BB21-Based Ad Vector Genomes pBB21.dE1.dE3 (SEQ ID NO:15) was constructed by several steps of gene synthesis (performed by GenScript; Piscataway, N.J.) and standard molecular cloning procedures. First, a 3576 bp DNA fragment (SEQ ID NO:33) containing the right end of the desired Ad vector genome (i.e. harboring the aforementioned E3 deletion, partial E4 sequence replacement, and transgene insertion site adjacent to the RITR) was synthesized and ligated, as an EcoRI-AseI restriction fragment, into EcoRI- and NdeI-digested pBR322 (GenBank accession number—J01749.1), leading to BB21 intermediate plasmid 1. Second, a 4256 bp fragment (SEQ ID NO:34) containing the left end of the desired Ad vector genome (i.e. harboring the aforementioned E1 deletion) was synthesized and ligated, as an SnaBI-EcoRI restriction fragment, into ZraI- and EcoRI-digested BB21 intermediate plasmid 1, leading to BB21 intermediate plasmid 2. Third, a 4077 bp fragment (SEQ ID NO:35) containing a middle Ad vector genome fragment was synthesized and ligated as a EcoRI-HpaI restriction fragment into EcoRI- and HpaI-digested BB21 intermediate plasmid 2, leading to BB21 intermediate plasmid 3 (SEQ ID NO:36). Fourth, the 18815 bp AbsI-EcoRI restriction fragment of the BB21 viral genome (SEQ ID NO:13) was ligated into AbsI- and EcoRI-digested BB21 intermediate plasmid 3, leading to the final plasmid pBB21.dE1.dE3 (SEQ ID NO:15).

pBB21.dE1.dE3.5IXP (SEQ ID NO:16) was constructed in the same way as pBB21.dE1.dE3 except that abovementioned BB21 intermediate plasmid 3 (SEQ ID NO:36) was first modified to contain the desired E1 deletion and Ad5 pIX promoter insertion. This was done by synthesis of a 224 bp fragment (SEQ ID NO:37) that was subsequently ligated as an AsiSI-FseI restriction fragment into AsiSI- and FseI-digested BB21 intermediate plasmid 3.

pBB21.FLuc (SEQ ID NO:38) and pBB21.RSVF-2A-GLuc (SEQ ID NO:39) are pBB21.dE1.dE3-derived plasmids that each harbor a BB21-based Ad vector genome equipped with a transgene expression cassette inserted at the location of the E1 deletion. The Ad vector genome sequences carried within these plasmids are set forth in SEQ ID NO:40 and SEQ ID NO:41, respectively. pBB21.FLuc carries a transgene expression cassette for firefly luciferase (FLuc). This cassette is driven by the cytomegalovirus major immediate early promoter (i.e. the "CMV promoter") and contains an SV40-derived polyadenylation signal. pBB21.RSVF-2A-Gluc carries a transgene expression cassette for "RSV-$F_{A2}$-2A-GLuc" (RSVF-2A-GLuc), which is a chimeric protein composed of the respiratory syncytial virus strain A2 fusion glycoprotein, a foot-and-mouth-disease virus 2A peptide, and Gaussia luciferase (GLuc). Like the FLuc cassette, this cassette is driven by a CMV promoter and carries an SV40 polyadenlyation signal. In addition, this cassette contains within its 5'untranslated region a sequence comprising intron 2 of the human Apolipoprotein A1 gene. The Fluc and RSVF-2A-GLuc expression cassettes were each constructed by several standard gene synthesis and molecular cloning steps after which they were ligated into the unique AsiSI restriction enzyme site of pBB21.dE1.dE3, generating pBB21.FLuc and pBB21.RSVF-2A-Gluc, respectively.

Construction of Single Plasmids Comprising BB24-Based Ad Vector Genomes pBB24.dE1.dE3 (SEQ ID NO:17) was constructed by several steps of gene synthesis (performed by GenScript) and standard molecular cloning procedures. First, a 8144 bp DNA fragment (SEQ ID NO:43) containing the left and rights ends of the desired Ad vector genome (i.e. harboring the aforementioned E1 deletion, E3 deletion, partial E4 sequence replacement, and transgene insertion site adjacent to the RITR) was synthesized and ligated, as an MfeI-AseI restriction fragment, into EcoRI- and NdeI-digested pBR322 (GenBank accession number J01749.1), leading to BB24 intermediate plasmid 1 (SEQ ID NO:44). Second, the 22482 bp NdeI-EcoRI restriction fragment of the BB24 viral genome (SEQ ID NO:14) was ligated into NdeI- and EcoRI-digested BB24 intermediate plasmid 1, leading to the final plasmid pBB24.dE1.dE3.

pBB24.dE1.dE3.5IXP (SEQ ID NO:18) was constructed in a similar manner. First, the abovementioned BB24 intermediate plasmid 1 (SEQ ID NO:44) was modified to carry the desired E1 deletion and Ad5 pIX promoter insertion. This was done by synthesis of a 2671 bp fragment (SEQ ID NO:45) that was subsequently ligated as an AsiSI-EcoRI restriction fragment into AsiSI- and EcoRI-digested BB24 intermediate plasmid 1. Second, the 19470 bp XbaI-EcoRI restriction fragment of the BB24 viral genome (SEQ ID NO:14) was ligated into the modified plasmid (digested with XbaI and EcoRI).

pBB24.FLuc (SEQ ID NO:46) and pBB24.RSVF-2A-GLuc (SEQ ID NO:47) are pBB24.dE1.dE3-derived plasmids that each contain a BB24-based Ad vector genome equipped with a transgene expression cassette inserted at the location of the E1 deletion. The Ad vector genome sequences carried within these plasmids are set forth in SEQ ID NO:48 and SEQ ID NO:49, respectively. pBB24.FLuc carries the same FLuc expression cassette as described herein for pBB21.FLuc. pBB24.RSVF-2A-GLuc carries the same RSVF-2A-GLuc expression cassette as described herein for pBB21.RSVF-2A-GLuc. These two cassettes were each constructed by several standard gene synthesis and molecular cloning steps after which they were ligated into the unique AsiSI restriction enzyme site of pBB24.dE1.dE3, generating pBB24.FLuc and pBB24.RSVF-2A-GLuc, respectively.

Generation and Production of BB21- and BB24-Based Adenoviral Vectors

Adenoviral vectors BB21.FLuc (also designated JAd2NVT003), BB21.RSVF-2A-GLuc (also designated JAd2NVT001), BB24.FLuc (also designated JAd3NVT003), and BB24.RSVF-2A-GLuc (also designated JAd3NVT001), which respectively comprise adenoviral vector genome sequences SEQ ID NO:40, SEQ ID NO:41, SEQ ID NO:48, and SEQ ID NO:49, were generated by transfection of the corresponding Ad vector genome plasmids (i.e. pBB21.FLuc, pBB21.RSVF-2A-GLuc, pBB24.FLluc, and pBB24.RSVF-2A-GLuc) into E1-complementing PER.C6 cells. Prior to transfection into PER.C6 cells, which were grown as adherent cell cultures in Dulbecco's modified Eagle's medium (DMEM) supplemented with 10% fetal bovine serum (FBS) and 10 mM $MgCl_2$, the Ad vector genome plasmids were digested with SwaI to release the respective adenoviral vector genomes from the plasmid. The transfections were performed according to standard procedures using Lipofectamine transfection reagent (Invitrogen; Carlsbad, Calif.). After harvesting of the viral rescue transfections, the viruses were further amplified by several successive infection rounds on PER.C6 cell cultures. The viruses were purified from crude viral harvests using a two-step cesium chloride (CsCl) density gradient ultracentrifugation procedure as described before (Havenga et al., "Novel replication-incompetent adenoviral B-group vectors: high vector stability and yield in PER.C6 cells," J. Gen. Virol. 87(8):2135-43 (2006)). Viral particle (VP) titers were measured by a spectrophotometry-based procedure described previously (Maizel et al., "The polypeptides of adenovirus: I. Evidence for multiple protein components in the virion and a comparison of types 2, 7A, and 12," Virology, 36(1):115-25 (1968)).

Example 2: Generation of E1- and E3-Deleted Vectors Based on the HAdV-4 Harboring Hexon and Fiber Sequences from Ape Adenoviruses In order to create replication-incompetent adenoviral vectors based on human adenovirus type 4 (HAdV-4) that are modified in hexon, or hexon and fiber sequences, plasmids were constructed carrying a complete HAdV-4 vector genome harboring the E1 and E3 deletions, transgene insertions, and hexon and/or fiber replacements as described below. Transgene expression cassettes were inserted into the E1 deletion of the vector. Transfection of the plasmids into E1 complementing cell lines such as HEK 293 or PER.C6 resulted in rescue of the HAdV-4 based vectors wherein the capsid proteins (hexon, or hexon and fiber) had been replaced by heterologous sequences derived from certain ape adenovirus isolates. The design and construction of the Ad vector plasmids is described in the following sections.

Design and Construction of Single Plasmids Comprising HAdV-4-Based Ad Vector Genomes The complete sequence of the HAdV-4 isolate used for vector design and construction (35990 bp) was previously determined (SEQ ID NO:19).

A single plasmid carrying a HAdV-4 based vector genome (harboring deletions to render it replication-incompetent, as well as to create space for the insertion of foreign transgene cassettes) was created using standard molecular biology and DNA cloning techniques. Briefly, DNA fragments comprising the left and right ends of the desired HAdV-4-based Ad vector were synthesized at GenScript and cloned into pBR322. Subsequently the missing middle portion of the HAdV-4 genome, a HindIII-HindIII restriction fragment of approximately 19 kbp, was obtained from purified wild type HAdV-4 genomic DNA (by restriction enzyme digestion) and then ligated into the left and right end-containing pBR322-based plasmid. This resulted in the generation of plasmid pAd4.dE1.dE3. This plasmid carries an E1- and E3-deleted HAdV-4-based Ad vector genome flanked by SwaI sites. These SwaI sites allow for excision of the vector genome from the plasmid for rescue of the adenoviral vector by transfection of an E1-complementing cell line, such as a PER.C6 or HEK293 cell line. At the location of the E1 deletion, the plasmid carries a transgene insertion site comprised by an AsiSI restriction enzyme site. Another transgene insertion site, comprised by a PacI site, is located adjacent to the right inverted terminal repeat.

Figure 13:
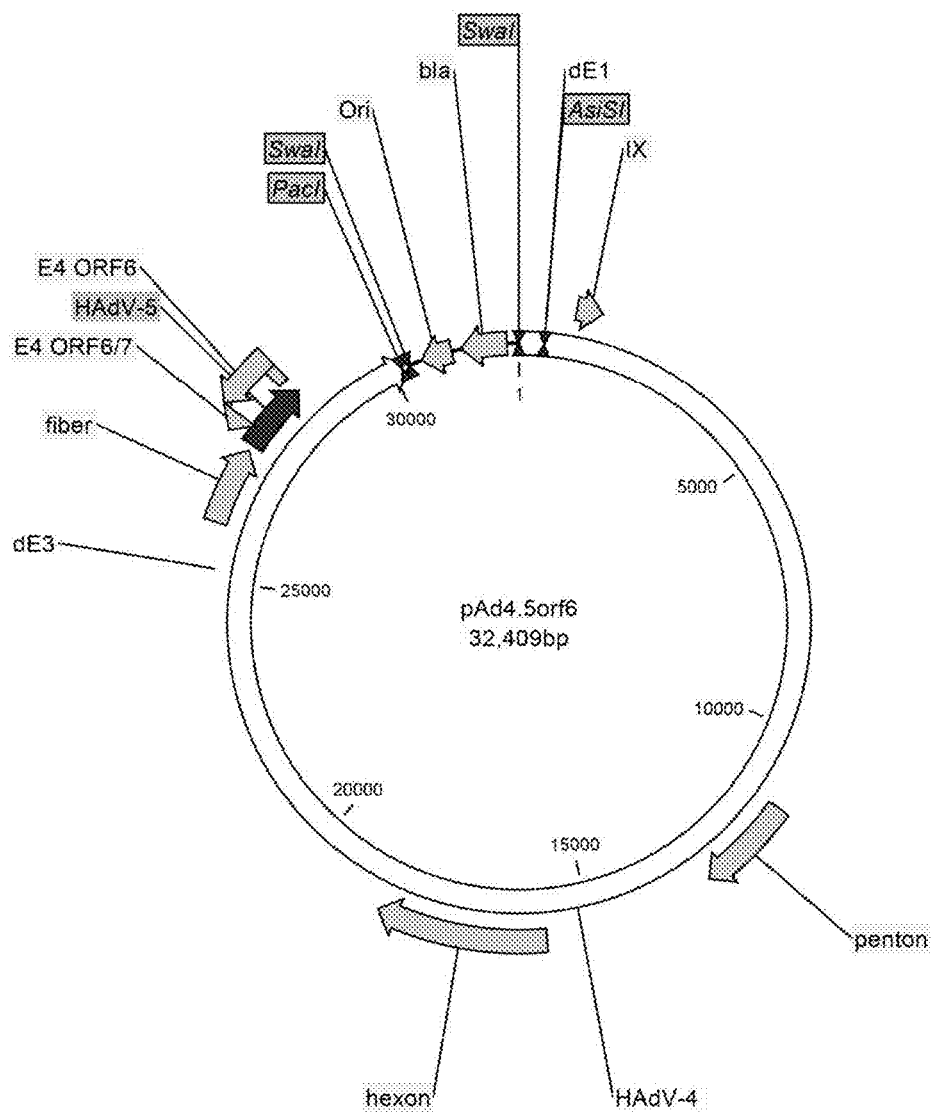
FIG. 13 shows a schematic of the plasmid pAd4.5orf6 (SEQ ID NO:20).

An E4 region-modified version of pAd4.dE1.dE3, pAd4.5orf6 (SEQ ID NO:20; FIG. 13) was also made. While pAd4.dE1.dE3 was created to contain the native HAdV-4 E4 sequence, pAd4.5orf6 was created to contain a modified E4 region in which nucleotides 33018-34165 of the native HAdV-4 sequence were replaced with a sequence containing E4 orf6 and orf6/7 sequences from HAdV-5 (i.e., nucleotides 32914-34077 of HAdV-5 GenBank Sequence AC_000008 (SEQ ID NO:50). The Ad vector genome sequence carried within pAd4.5orf6 set forth in SEQ ID NO:51. pAd4.5orf6 was generated by excision and replacement, using standard cloning techniques, of a 2.9 kb PsiI-PacI fragment of pAd4.dE1.dE3 by a synthesized sequence (generated by GenScript) carrying the described modification. Apart from the modified E4 region, the plasmids pAd4.dE1.dE3 and pAd4.5orf6 are the same. A map of pAd4.5orf6 is shown in FIG. 12. The E1 and E3 deletions, as well as regions coding for hexon and fiber are indicated.

Both HAdV-4-based vector versions could be rescued upon transfection of the respective plasmids (i.e. pAd4.dE1.dE3 and pAd4.5orf6) in suitable E1-complementing cells (like HEK293 and PER.C6). However, the use of the E4 orf6-containing sequence from HAdV-5 was found to improve vector yields and efficiency of production. Previously, an analogous replacement in a HAdV-35-based vector showed similar results (Havenga et al., "Novel replication-incompetent adenoviral B-group vectors: high vector stability and yield in PER.C6 cells," J. Gen. Virol. 87(8):2135-43 (2006)).

pAd4.dE1.dE3 and pAd4.5orf6 each carry within the Ad vector genome a unique AsiSI restriction site at the location of the E1 deletion and a unique PacI restriction site adjacent to the right inverted terminal repeat. These sites allow for insertion of transgene expression cassettes at the respective locations of the Ad vector genome by standard cloning techniques. For example, one or more of such cassettes may be inserted at one or both of these locations.

pAd4.FLuc and pAd4.RSVF-2A-GLuc are transgene expression cassette-containing versions of pAd4.5orf6, respectively carrying transgene cassettes encoding firefly luciferase (FLuc) and a fusion protein comprising the respiratory syncytial virus A2 fusion glycoprotein, a foot-and-mouth-disease virus-derived 2A peptide, and *Gaussia* luciferase (RSVF-2A-GLuc). They were constructed by insertion of the respective cassettes into the AsiSI site of pAd4.5orf6 by standard cloning techniques. The two transgene cassettes are the same as those employed in Example 1 in the context of BB21- and BB24-based adenoviral vectors.

Figure 14:
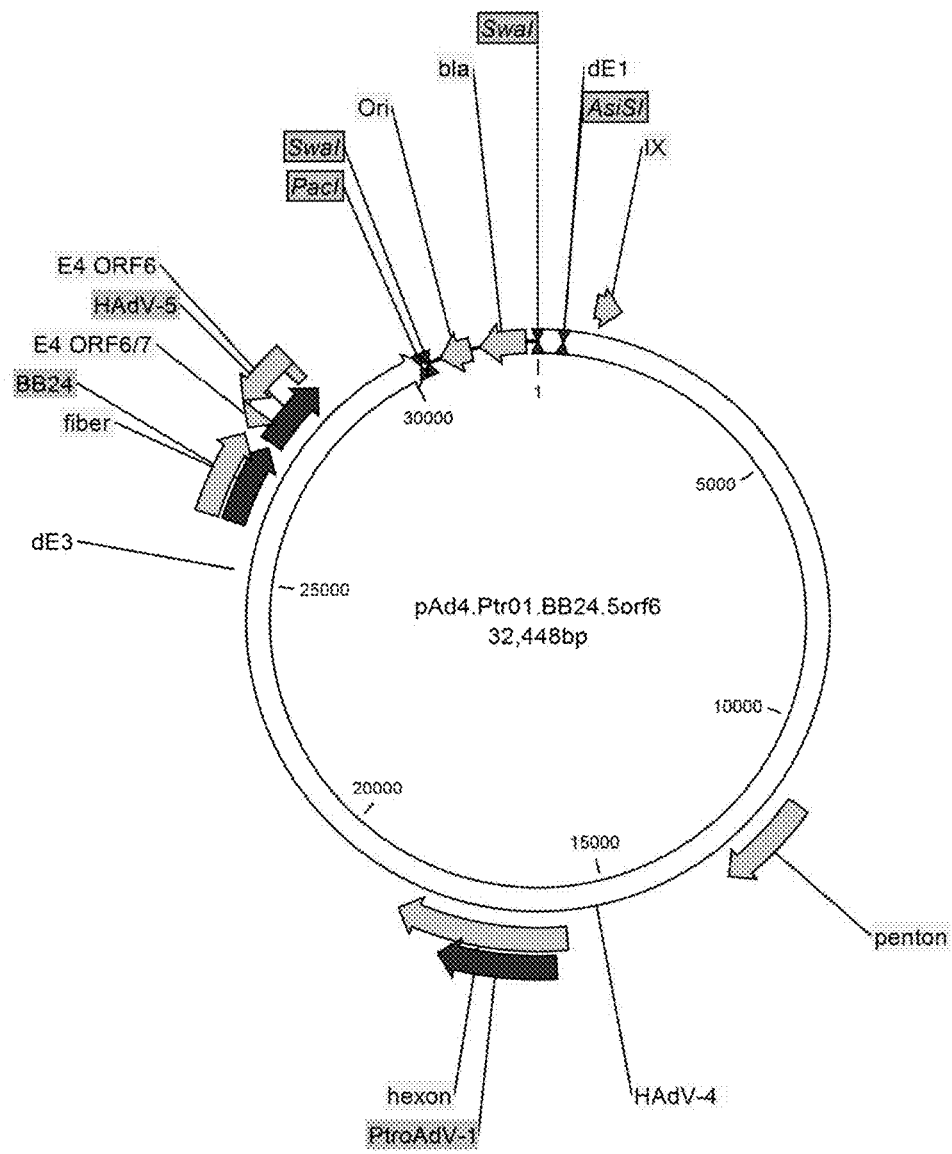
FIG. 14 shows a schematic of the plasmid pAd4.Ptr01.BB24.5orf6 (SEQ ID NO:23).

Design and Construction of Single Plasmids Comprising HAdV-4 Based Vectors Carrying Hexon and Fiber Sequence Replacements HAdV-4-based vector genome plasmids were constructed in which hexon and fiber coding sequences were replaced by those of certain chimpanzee adenovirus isolates that like HAdV-4 have been allocated to human Ad species E. Adenovirus isolates that served as hexon sequence donor for these constructions are PtroAdV-1 and PtroAdV-13, for which partial hexon nucleotide sequence were previously deposited in GenBank (under JN163971 and JN163983, respectively). Fiber sequences used for the constructions came from the novel chimpanzee adenovirus isolates BB21 and BB24, which are described in Example 1 herein. Two different combinations of hexon and fiber sequence replacements were made (in context of HAdV-4-based vector genome plasmids): (1) PtroAdV-1 hexon nucleotide sequences were combined with nucleotide sequences encoding the BB24 fiber (SEQ ID NO:4) and (2) PtroAdV-13 hexon nucleotide sequences were combined with nucleotide sequences encoding a BB21 fiber variant (SEQ ID NO:3). Constructed plasmids carrying said first combination of hexon and fiber sequence replacements are pAd4.Ptr01.BB24.5orf6 (SEQ ID NO:23; FIG. 13), pAd4.Ptr01.BB24.5orf6.Fluc (SEQ ID NO:21), and pAd4.Ptr01.BB24.5orf6.RSVF-2A-Gluc (SEQ ID NO:52), which harbor the Ad vector genome sequences as set forth in SEQ ID NO:53, SEQ ID NO:54, and SEQ ID NO:55, respectively. Constructed plasmids carrying said second combination of hexon and fiber sequence replacements are pAd4.Ptr13.BB21.5orf6 (SEQ ID NO:24; FIG. 14), pAd4.Ptr13.BB21.5orf6.Fluc (SEQ ID NO:22), and pAd4.Ptr13.BB21.5orf6.RSVF-2A-Gluc (SEQ ID NO:56), which contain the Ad vector genome sequences as set forth in SEQ ID NO:57, SEQ ID NO:58, and SEQ ID NO:59, respectively.

Above hexon- and fiber-modified Ad vector genome plasmids were each constructed by standard gene synthesis and molecular cloning procedures. Sequence fragments comprising the respective modified hexon and fiber sequences were synthesized (by GenScript) and then subjected to sequential subcloning steps that together amounted to insertion of those sequences into pAd4.5orf6 (replacing therein the corresponding native HAdV-4 hexon- and fiber-comprising sequences). The resulting plasmids, pAd4.Ptr01.BB24.5orf6 and pAd4.Ptr13.BB21.5orf6, were subsequently equipped with the aforementioned expression cassettes for Fluc and RSVF-2A-Gluc by cloning of these cassettes into the unique AsiSI site of these plasmids (leading to construction of pAd4.Ptr01.BB24.5orf6.Fluc, pAd4.Ptr01.BB24.5orf6.RSVF-2A-Gluc, pAd4.Ptr13.BB21.5orf6.Fluc, and pAd4.Ptr13.BB21.5orf6.RSVF-2A-Gluc).

The hexon sequence replacements carried out herein resulted in the construction of chimeric hexon-encoding sequences "Ptr01" (SEQ ID NO:9) and "Ptr13" (SEQ ID NO:11). These sequences constitute HAdV-4 hexon genes wherein the hypervariable regions (HVRs)-encoding sequences were replaced by those of PtroAdV-1 and PtroAdV-13, respectively. The chimeric hexon polypeptides encoded by Ptr01 and Ptr13 are set forth in SEQ ID NO:10 and SEQ ID NO:12, respectively.

The fiber sequence replacements carried out herein entailed the replacement of the complete fiber-encoding sequence of HAdV-4 by sequences derived from fiber donor isolates BB21 and BB24, which are described in Example 1 herein. The replacement nucleotide sequences respectively encode a BB21 fiber variant (SEQ ID NO:3) and the BB24 fiber (SEQ ID NO:4). FIG. 16 displays a polypeptide alignment of these two fibers and BB21 fiber (SEQ ID NO:2).

Generation and Production of HAdV-4-Based Vectors Carrying Hexon and Fiber Sequence Replacements Adenoviral vectors Ad4Ptr01-BB24.FLuc (also designated Ad4C1NVT003), Ad4Ptr01-BB24.RSVF-2A-GLuc (also designated Ad4C1NVT001), Ad4Ptr13-BB21.FLuc (also designated Ad4C2NVT003), and Ad4Ptr13-BB21.RSVF-2A-GLuc (also designated Ad4C2NVT001), which respectively comprise adenoviral vector genome sequences SEQ ID NO:54, SEQ ID NO:55, SEQ ID NO:58, and SEQ ID NO:59, were generated by transfection into E1-complementing PER.C6 cells of SwaI-digested Ad vector genome plasmids pAd4.Ptr01.BB24.5orf6.FLuc, pAd4.Ptr01.BB24.5orf6.RSVF-2A-GLuc, pAd4.Ptr13.BB21.5orf6.FLuc, and pAd4.Ptr13.BB21.5orf6.RSVF-2A-GLuc, respectively. Likewise, the control adenoviral vectors Ad4.FLuc and Ad4.RSVF-2A-GLuc were generated from plasmids pAd4.FLuc and pAd4.RSVF-2A-GLuc, respectively. All transfections and subsequent vector amplifications, purifications, and titrations were done according to the same standard procedures as described for the BB21- and BB24-based vectors in Example 1 herein.

Assessment of Reduction in Anti-Adenovirus Neutralization Titer as a Consequence of Replacement of the HAdV-4 Hexon and Fiber Recombinant adenoviruses expressing firefly luciferase (with capsid protein hexon and fiber replacements, constructed as described) were used to determine whether replacing the capsid proteins, hexon and fiber, with homologous proteins from ape adenoviruses resulted in reduction in neutralization by human serum samples that harbored anti-HAdV-4 neutralizing activity.

Briefly, equal infectious-unit aliquots of crude viral stocks of the adenovirus to be tested were incubated with serial dilutions of a serum sample. The starting dilution used for these assays was 16-fold. Following the incubation period, the adenovirus aliquot was used to infect an indicator cell line, such as A549 cells where any adenovirus that was not neutralized as a result of the incubation with serum may infect the indicator cells. The virus transduced cells were then incubated overnight to allow for the expression of the firefly luciferase transgene. The neutralization titer of any serum sample harboring anti-adenovirus neutralizing activity was the minimum dilution of the serum that could achieve a 90% reduction in luciferase activity in the reporter cells compared to the adenovirus aliquot which was not incubated with serum.

The anti-adenovirus neutralization titer in 22 human serum samples (out of 79 samples tested) that were found to harbor Ad4.FLuc neutralizing antibodies was determined (Table 1). When compared to the neutralization titers of the same serum samples against the chimeric adenoviruses Ad4.Ptr01-BB24.FLuc and Ad4Ptr13-BB21.FLuc respectively, it was evident that there is a pronounced reduction in the anti-adenovirus neutralizing activity as a result of the capsid alterations in the hexon and fiber coding sequences. These results confirm that adenoviral hexon and fiber proteins contain important antigenic determinants of antibody-mediated adenovirus neutralization. They also illustrate that pre-existing anti-vector humoral immunity in humans against human adenovirus-based vectors (in this case Ad4.FLuc, a HAdV-4-based vector) could be circumvented by swapping the vector's hexon and fiber proteins by those of ape adenoviruses likely to have a low seroprevalence in human populations.

Taken together, Ad4Ptr01-BB24.FLuc and Ad4Ptr13-BB21.Fluc proved to be serologically distinct from their parental HAdV-4-based vector Ad4.Fluc. Moreover, there was either no (in case of Ad4Ptr01-BB24.FLuc) or only limited (in case of Ad4Ptr13-BB21.Fluc) neutralizing activity found against these two vectors in a panel of Ad4.Fluc-neutralizing human sera.

TABLE 1

Anti-adenovirus neutralization titers in human sera positive for anti-Ad4 neutralizing antibodies

| Serum # | Anti-AdV-4.FLuc titer | Anti-Ad4.Ptr01-BB24.FLuc titer | Anti-Ad4.Ptr13-BB21.FLuc titer |
|---|---|---|---|
| 1 | 726 | <16 | <16 |
| 2 | 328 | <16 | <16 |
| 3 | 285 | <16 | <16 |
| 4 | 252 | <16 | <16 |
| 5 | 116 | <16 | <16 |
| 6 | 102 | <16 | <16 |
| 7 | 86 | <16 | <16 |
| 8 | 78 | <16 | <16 |
| 9 | 70 | <16 | <16 |
| 10 | 63 | <16 | 110 |
| 11 | 59 | <16 | <16 |
| 12 | 58 | <16 | <16 |
| 13 | 53 | <16 | <16 |
| 14 | 50 | <16 | 47 |
| 15 | 48 | <16 | <16 |
| 16 | 42 | <16 | <16 |
| 17 | 40 | <16 | <16 |
| 18 | 33 | <16 | <16 |
| 19 | 32 | <16 | <16 |
| 20 | 31 | <16 | <16 |
| 21 | 29 | <16 | <16 |
| 22 | 22 | <16 | <16 |

<16 indicates there was no neutralization observed at lowest dilution of 16-fold Cellular and Humoral Immune Responses Induced by Novel Adenoviral Vectors Examples 3 to 8 describe experiments performed to assess the immunogenicity of four novel vectors generate herein, adenoviral vectors BB21, BB24, Ad4Ptr13-BB21, and Ad4Ptr01-BB24. In these experiments, the novel vectors were assessed for their abilities to induce humoral and cellular immune responses against vector-encoded (model) antigens in mice after intramuscular immunization. The vectors were tested using two different antigens: Firefly luciferase (FLuc) and RSV-$F_{A2}$-2A-GLuc (RSVF-2A-GLuc). RSVF-2A-GLuc is a chimeric protein composed of the respiratory syncytial virus strain A2 fusion glycoprotein, a foot-and-mouth-disease virus 2A peptide, and *Gaussia* luciferase (GLuc). Each vector was compared side-by-side with a benchmark vector based on human adenovirus type 26 (HAdV-26, also referred to herein as Ad26) carrying the same antigen-encoding transgene cassette. Immune responses against the respective antigens were measured using well-known immunological assays, such as enzyme-linked immunospot assay (ELISPOT), enzyme-linked immunosorbent assay (ELISA), and, in case of the RSVF-2A-GLuc antigen, a respiratory syncytial virus neutralization assay (VNA).

Example 3: Cellular Immune Responses Induced by BB21.FLuc and BB24.FLuc

Figure 1B:
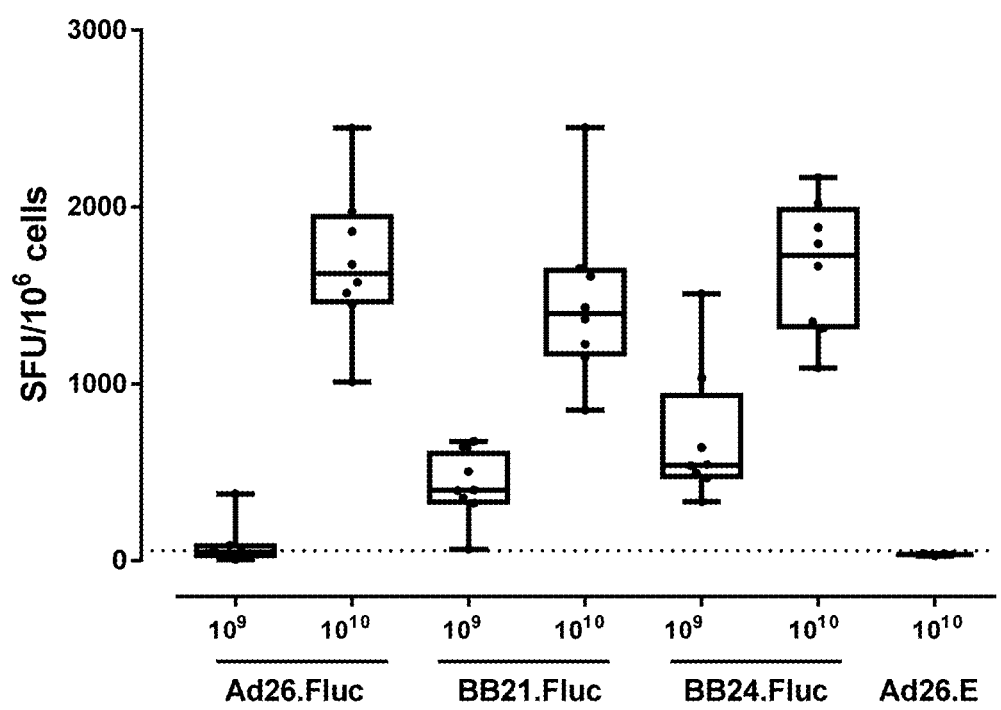

To evaluate the cellular immunogenicity of novel adenoviral vectors BB21 and BB24, Balb/C mice were immunized intramuscularly with Ad26.FLuc (positive control), BB21 or BB24 vectors expressing Firefly luciferase (i.e. BB21.FLuc or BB24.FLuc), or with an adenovector not encoding a transgene (Ad26 empty). Two vector doses were tested for administration: $10^9$ and $10^{10}$ viral particles (vp) per mouse. Two weeks after the immunization, mice were sacrificed and splenocytes were isolated (FIG. 1A). Cellular immune responses were determined by ex-vivo ELISPOT assay measuring the relative number of IFN-γ-secreting cells after overnight splenocyte stimulation with a 15mer overlapping FLuc peptide pool (FIG. 1B). The results show that at the higher-dose immunization ($10^{10}$), the cellular immune responses induced by BB21.FLuc and BB24.FLuc were about as high as the response seen for Ad26.FLuc. By contrast, at the lower-dose immunization ($10^9$), BB21.FLuc and BB24.FLuc both gave a higher response than Ad26.FLuc. Overall, the cellular immune responses induced by the FLuc-expressing recombinant BB21 and BB24 adenoviral vectors of the invention clearly indicate potent immunogenicity of these vectors in mice.

Example 4: Cellular Immune Responses Induced by Ad4Ptr13-BB21.FLuc

Figure 2:
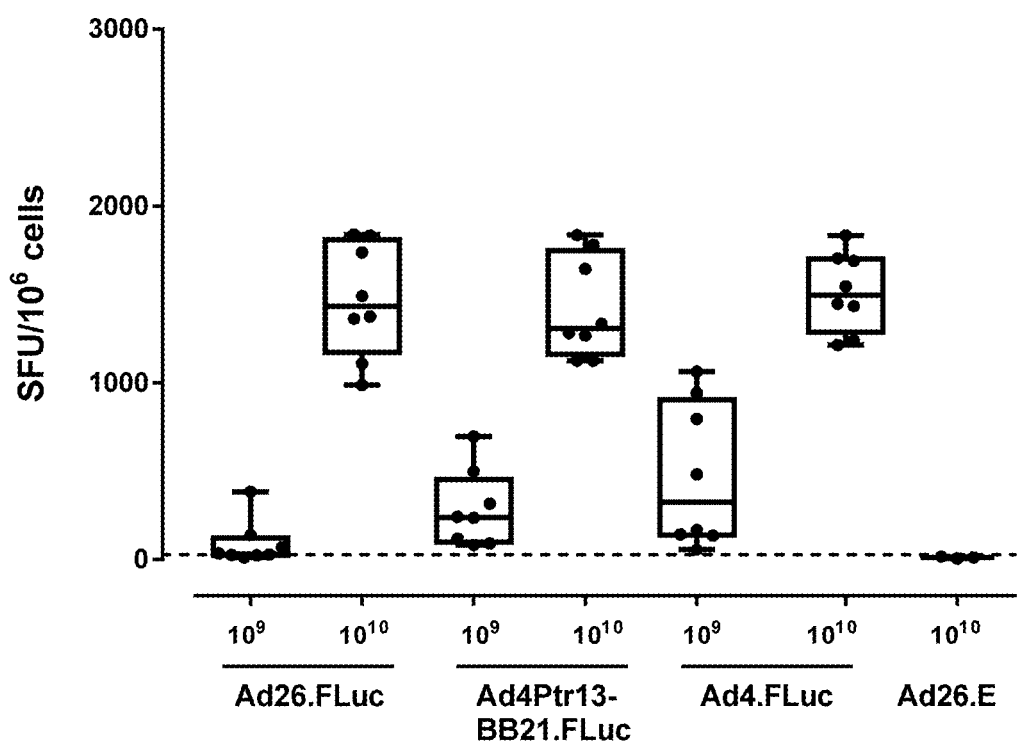
FIG. 2 shows cellular immune responses induced by Ad4Ptr13-BB21.FLuc and Ad4.FLuc. The graph shows the cellular immune responses induced by Ad26.FLuc, Ad4Ptr13-BB21.FLuc and Ad4.Fluc against the vector-encoded antigen (i.e. Fluc) as determined by IFN-γ ELISPOT analysis.

To evaluate the cellular immunogenicity of the novel engineered adenoviral vector Ad4Ptr13-BB21, Balb/C mice were immunized intramuscularly with Ad4Ptr13-BB21, Ad26 (positive control), or Ad4 (parental vector of Ad4Ptr13-BB21), each expressing Firefly luciferase (Fluc), or with an adenovector not encoding a transgene, Ad26 empty. Two vector doses were tested for administration: $10^9$ and $10^{10}$ viral particles (vp) per mouse. At two weeks after immunization, mice were sacrificed and splenocytes were isolated, according to the same experimental setup as used for BB21.Fluc and BB24.Fluc (FIG. 1A). Cellular immune responses were determined by ex-vivo ELISPOT assay measuring the relative number of IFN-γ-secreting cells after overnight splenocyte stimulation with a 15mer overlapping FLuc peptide pool (FIG. 2). The results show that at the higher-dose immunization ($10^{10}$), the cellular immune response induced by Ad4Ptr13-BB21.FLuc was about as high as that seen for the benchmark control vector Ad26.Fluc, while at the lower-dose immunization ($10^9$), Ad4Ptr13-BB21.FLuc gave a slightly higher response than Ad26.Fluc.

Overall, the cellular immune responses induced by the FLuc-expressing, novel engineered Ad4Ptr13-BB21 adenoviral vector, which comprises a BB21 fiber variant (SEQ ID NO:3), clearly indicate potent immunogenicity of this vector in mice.

Example 5: Cellular Immune Responses Induced by Ad4Ptr01-BB24.FLuc

Figure 3:
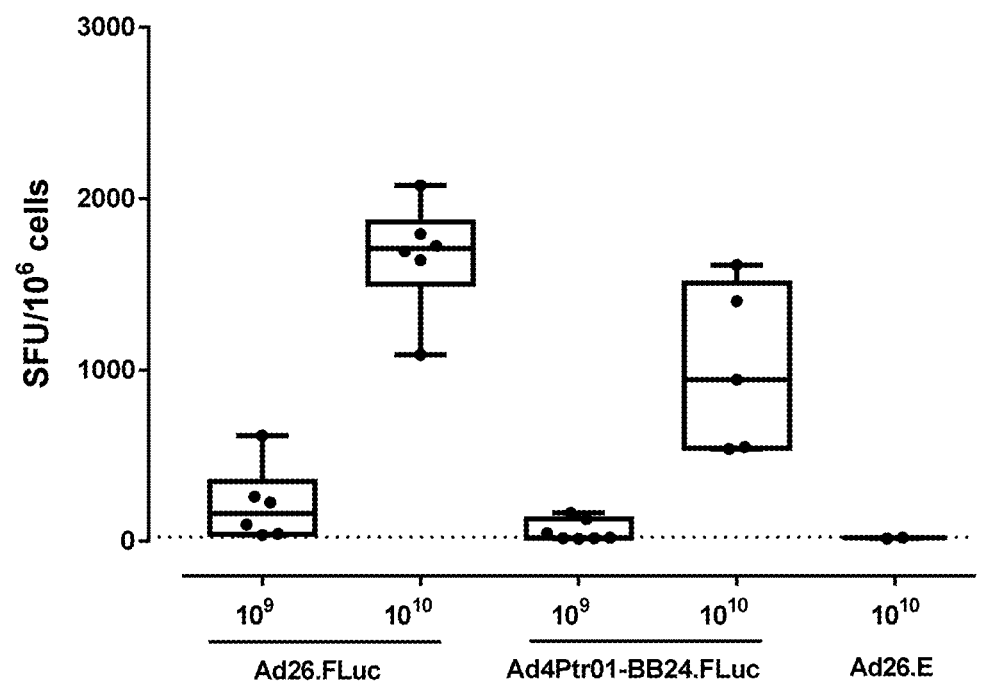
FIG. 3 shows cellular immune responses induced by Ad4Ptr01-BB24.FLuc. The graph shows the cellular immune responses induced by Ad26.FLuc and Ad4Ptr01-BB24.FLuc against the vector-encoded-antigen (i.e. Fluc) as determined by IFN-γ ELISPOT analysis.

To evaluate the cellular immunogenicity of the novel engineered adenoviral vector Ad4Ptr01-BB24.FLuc, Balb/C mice were immunized intramuscularly with Ad26.FLuc (positive control), Ad4Ptr01-BB24 expressing FLuc, or with an adenovector not encoding a transgene, Ad26 empty. Two doses were tested for administration: $10^9$ and $10^{10}$ viral particles (vp) per mouse. At two weeks after immunization, mice were sacrificed and splenocytes were isolated, according to the same experimental setup as used for BB21.Fluc and BB24.Fluc (FIG. 1A). Cellular immune responses were determined by ex-vivo ELISPOT assay measuring the relative number of IFN-γ-secreting cells after overnight splenocyte stimulation with a 15mer overlapping FLuc peptide pool (FIG. 3). The results show that, at the higher dose, Ad4Ptr01-BB24.FLuc clearly induced cellular immune responses against the encoded antigen, with readouts close to, but somewhat lower than, those seen for the positive control vector Ad26.Fluc.

Overall, the cellular immune responses induced by the FLuc-expressing, novel engineered Ad4Ptr01-BB24 adenoviral vector, which comprises the BB24 fiber (SEQ ID NO:4), clearly indicate immunogenicity of this vector in mice.

Example 6: Cellular and Humoral Immune Responses Induced by BB21.RSVF-2A-GLuc

Figure 4A:
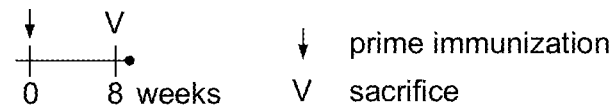
FIG. 4A-FIG. 4D show cellular and humoral immune responses induced by BB21.RSVF-2A-GLuc.

The immunogenicity of novel adenoviral vector BB21 was further evaluated using RSV-$F_{A2}$-2A-GLuc (RSVF-2A-GLuc) as a vector-encoded (model) vaccine antigen. Balb/C mice were immunized intramuscularly with Ad26.RSVF-2A-GLuc (positive control) or BB21.RSVF-2A-GLuc (both at $10^8$, $10^9$ and $10^{10}$ viral particles per mouse), or with Ad26.FLuc or BB21.FLuc (both at $10^{10}$ viral particles per mouse). Mice were sacrificed at eight weeks and blood samples and splenocytes were collected (FIG. 4A). Different immune parameters were assessed as described below.

Figure 4B:
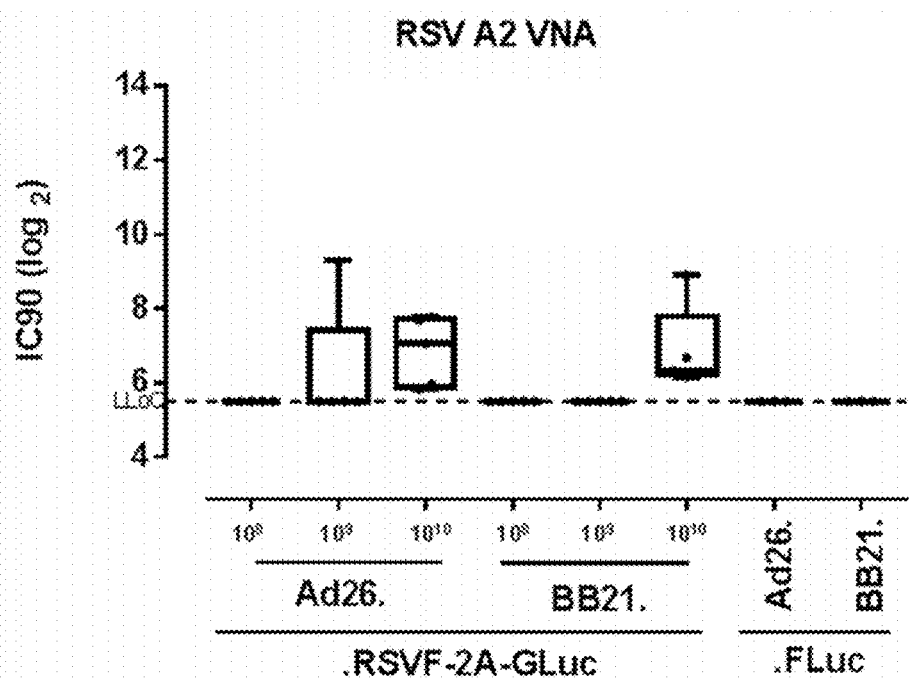

A virus neutralization assay was performed in order to assess the capacity of BB21.RSVF-2A-Gluc to elicit respiratory syncytial virus-neutralizing-antibodies. FIG. 4B depicts the respiratory syncytial virus strain A2 (RSV A2) VNA titers measured for sera samples collected eight weeks after immunization. Each dot represents one mouse, the bars represent the group mean, and the dotted line corresponds to the lower limit of quantification (LLOQ=6.88; mean endpoint titer of linearity samples). The results show that the $10^{10}$ vp-dose immunizations with BB21.RSVF-2A-Gluc gave rise to RSV A2 neutralization titers in the same range as those found for the benchmark Ad26 vector encoding the same antigen.

Figure 4C:
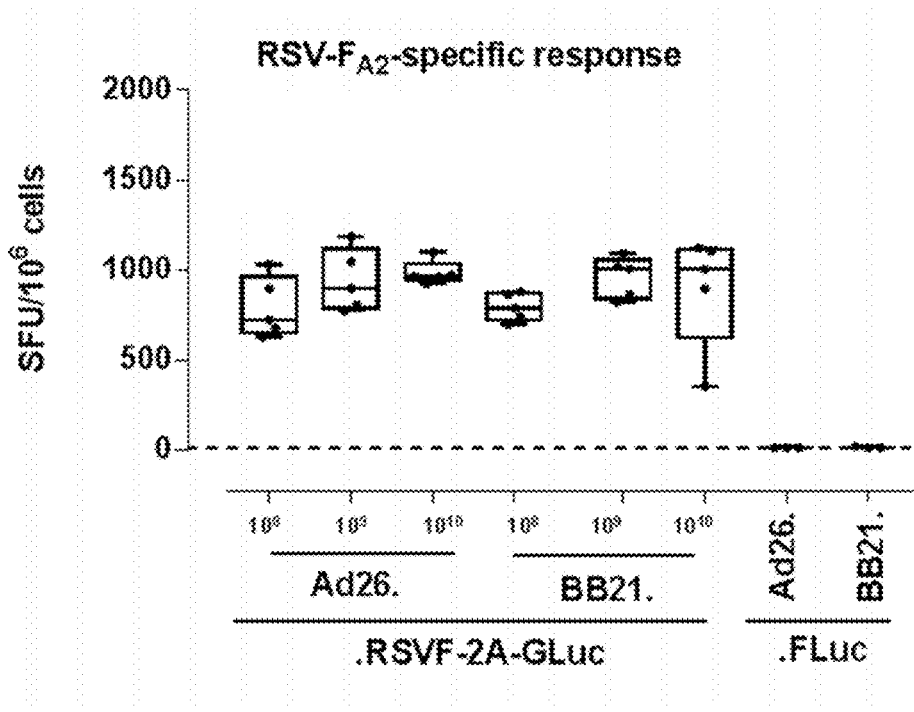

Induction of cellular immunity against the vector-encoded antigen was evaluated by an RSV-$F_{A2}$-specific ELISPOT assay. To this end, eight weeks after immunization, splenocytes from immunized mice were isolated and stimulated overnight with 15mer overlapping peptides spanning the RSV-$F_{A2}$ protein and cellular immune responses were determined by ex-vivo ELISPOT assay measuring the relative number of IFN-γ-secreting cells. The data show that the antigen-specific cellular immune responses elicited by BB21.RSVF-2A-GLuc were dose-dependent and, per dose, similar in magnitude to those induced by the benchmark vector, Ad26.RSVF-2A-GLuc (FIG. 4C). As expected, no RSV-$F_{A2}$-specific responses were measured from splenocytes of mice immunized with adenovectors encoding Firefly luciferase.

Figure 4D:
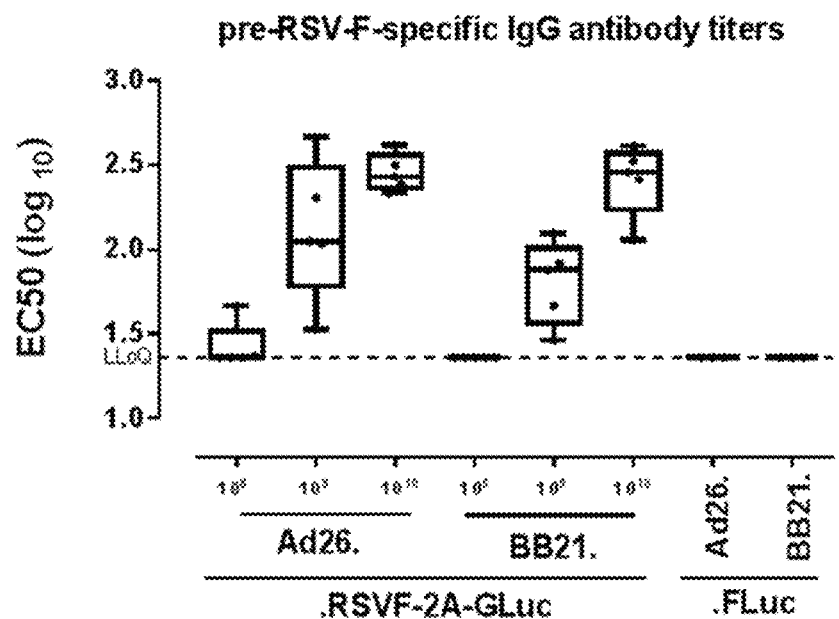

The ability of the RSVF-2A-GLuc-expressing vectors to elicit RSV-$F_{A2}$-specific IgG antibodies was assessed by ELISA. Sera collected 8 weeks post-immunization from the mice immunized with Ad26 or BB21 vectors expressing RSVF-2A-GLuc or Firefly luciferase were tested in an anti-RSV $F_{A2}$ IgG antibody ELISA. Specifically, this ELISA detects IgG antibodies capable of binding to a recombinant stable pre-fusion RSV-$F_{A2}$ protein (pre-RSV-F). The results show that BB21.RSVF-2A-GLuc dose-dependently elicited pre-RSV-F-specific IgG antibody titers similar to those induced by Ad26.RSVF-2A-GLuc (FIG. 4D). By contrast, as expected, no RSV-$F_{A2}$-specific antibody titers were detected in sera from mice immunized with vectors encoding Firefly luciferase.

Altogether, the data show that the BB21 vector induced potent cellular and humoral immune responses against the encoded antigen, similar in magnitude to those induced by the benchmark vector based on HAdV-26. These immune responses clearly indicate potent immunogenicity of the BB21 vector in mice.

Example 7: Cellular and Humoral Immune Responses Induced by BB24.RSVF-2A-GLuc

The immunogenicity of novel adenoviral vector BB24 was further evaluated using RSV-$F_{A2}$-2A-GLuc (RSVF-2A-GLuc) as a vector-encoded (model) vaccine antigen. Balb/C mice were immunized intramuscularly with Ad26.RSVF-2A-GLuc (positive control), BB24.RSVF-2A-GLuc, or Ad48.RSVF-2A-GLuc (each at $10^8$, $10^9$ and $10^{10}$ viral particles per mouse) or with Ad26.FLuc, BB24.Fluc, or Ad48.FLuc (each at $10^{10}$ viral particles per mouse). According to the same experimental setup as used for BB21.RSVF-2A-GLuc (FIG. 4A), mice were sacrificed at eight weeks post-immunization and blood and splenocytes were collected. Different immune parameters were assessed as described below.

Figure 5A:
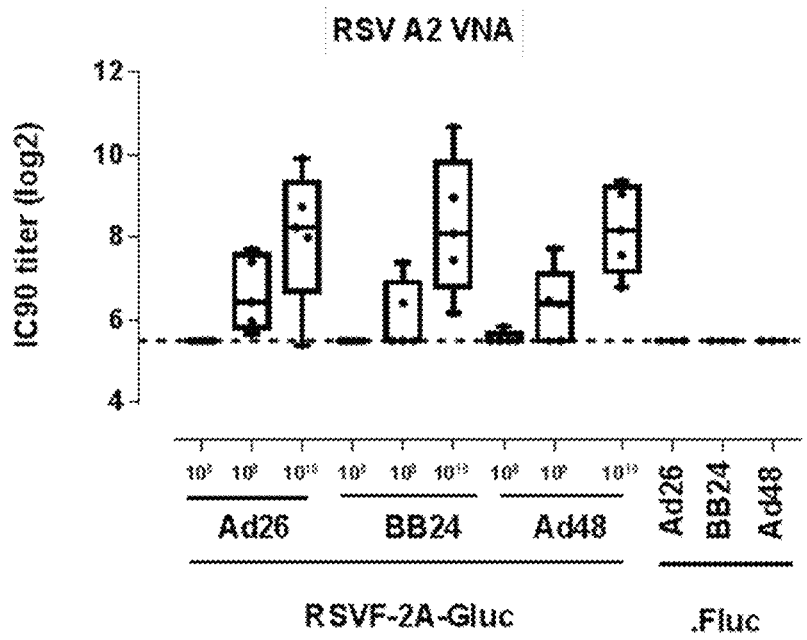
FIG. 5A-FIG. 5C show cellular and humoral responses induced by BB24.RSVF-2A-GLuc.
Figure 5B:
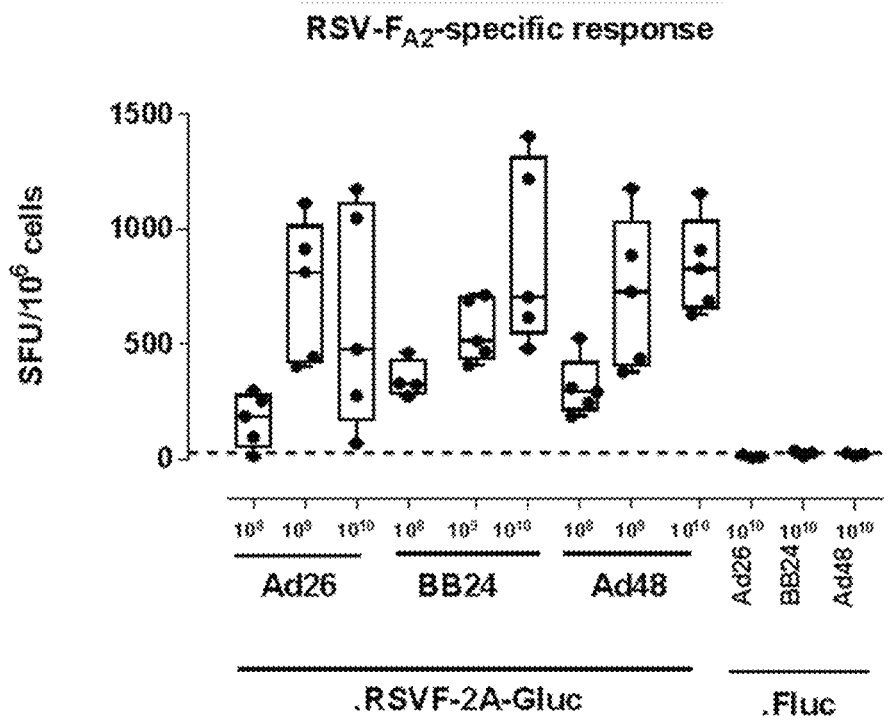

A virus neutralization assay was performed in order to assess the capacity of BB24.RSVF-2A-Gluc to elicit respiratory syncytial virus-neutralizing antibodies. FIG. 5A depicts the respiratory syncytial virus strain A2 (RSV A2) VNA titers measured for sera samples collected eight weeks after immunization. Each dot represents one mouse, the bars represent the group mean, and the dotted line corresponds to the lower limit of quantification (LLOQ=6.88; mean endpoint titer of linearity samples). The results seen for the three vectors are similar: neutralization titers were seen for several or all of the $10^9$ and $10^{10}$ vp-dose immunizations while no, or hardly any, neutralization titers were detected at the $10^8$ vp dose. Induction of cellular immunity against the vector-encoded antigen was evaluated by an RSV-$F_{A2}$-specific ELISPOT assay. To this end, eight weeks after immunization, splenocytes from immunized mice were isolated and stimulated overnight with 15mer overlapping peptides spanning the RSV-$F_{A2}$ protein and cellular immune responses were determined by ex-vivo ELISPOT assay measuring the relative number of IFN-γ-secreting cells. The data show that antigen-specific cellular immune responses elicited by BB24.RSVF-2A-GLuc were dose-dependent and, per dose, at least similar in magnitude to those induced by the comparator vectors, Ad26.RSVF-2A-GLuc and Ad48.RSVF-2A-GLuc (FIG. 5B). As expected, no RSV-$F_{A2}$-specific responses were measured from splenocytes of mice immunized with adenovectors encoding Firefly luciferase.

Figure 5C:
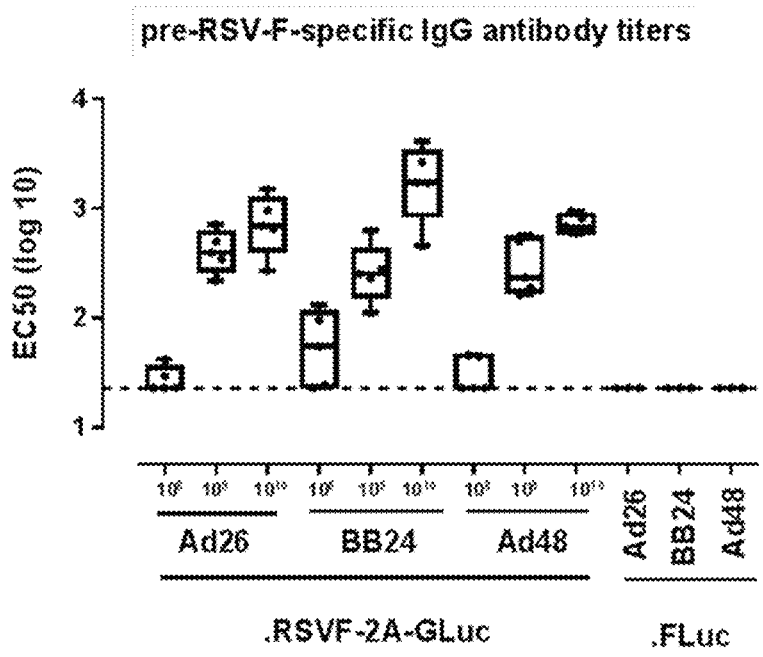

The ability of the RSVF-2A-GLuc-expressing vectors to elicit RSV-$F_{A2}$-specific IgG antibodies was assessed by ELISA. Sera collected 8 weeks post-immunization from the mice immunized with Ad26, Ad48, orBB24 vectors expressing RSVF-2A-GLuc or Firefly luciferase were tested in an anti-RSV $F_{A2}$ IgG antibody ELISA. Specifically, this ELISA detects IgG antibodies capable of binding to a recombinant stable pre-fusion RSV-$F_{A2}$ protein (pre-RSV-F). The results show that BB24.RSVF-2A-GLuc dose-dependently elicited pre-RSV-F-specific IgG antibody titers similar to those induced by Ad26.RSVF-2A-GLuc and Ad48.RSVF-2A-GLuc (FIG. 5C). By contrast, as expected, no RSV-$F_{A2}$-specific titers were detected in sera from mice immunized with the vectors encoding Firefly luciferase.

Altogether, the data show that the BB24 vector induced potent cellular and humoral immune responses against the encoded antigen, similar in magnitude to those induced by the benchmark vector based on HAdV-26. These immune responses clearly indicate potent immunogenicity of the BB24 vector in mice.

Example 8: Cellular and Humoral Immune Responses Induced by Ad4Ptr01-BB24.RSVF-2A-GLuc and Ad4Ptr13-BB21.RSVF-2A-GLuc The respective immunogenicities of novel engineered adenoviral vectors Ad4Ptr01-BB24 and Ad4Ptr13-BB21 were further evaluated using RSV-$F_{A2}$-2A-GLuc (RSVF-2A-GLuc) as a vector-encoded (model) vaccine antigen. Balb/C mice were immunized intramuscularly with Ad26.RSVF-2A-GLuc (positive control), Ad4Ptr01-BB24.RSVF-2A-GLuc, or Ad4Ptr13-BB21.RSVF-2A-GLuc (each at $10^8$, $10^9$ and $10^{10}$ viral particles per mouse) or with Ad26.FLuc, Ad4Ptr01-BB24.FLuc, or Ad4Ptr13-BB21.FLuc (each at $10^{10}$ viral particles per mouse). According to the same experimental setup as used for BB21.RSVF-2A-GLuc (FIG. 4A), blood samples and splenocytes were collected eight weeks post immunization. Different immune parameters were assessed as described below.

Figure 6A:
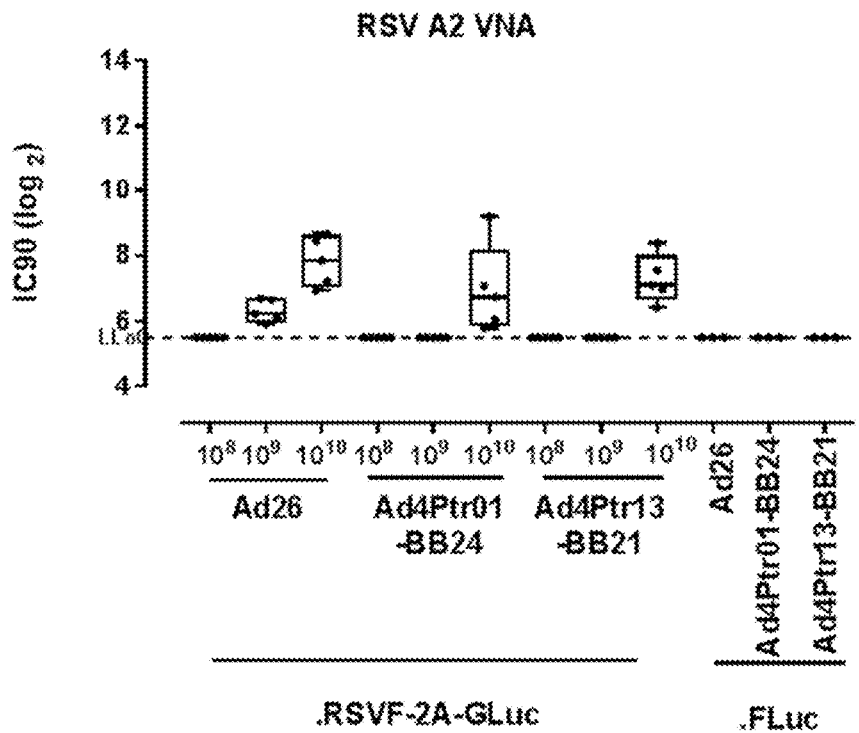
FIG. 6A-FIG. 6C show cellular and humoral responses induced by Ad4Ptr01-BB24.RSVF-2A-GLuc and Ad4Ptr13-BB21.RSVF-2A-GLuc.

Virus neutralization assays were performed in order to assess the capacity of Ad4Ptr01-BB24.RSVF-2A-GLuc and Ad4Ptr13-BB21.RSVF-2A-GLuc to elicit respiratory syncytial virus-neutralizing antibodies. FIG. 6A depicts the respiratory syncytial virus strain A2 (RSV A2) VNA titers measured for sera samples collected eight weeks after immunization. Each dot represents one mouse, the bars represent the group mean, and the dotted line corresponds to the lower limit of quantification (LLOQ=6.88; mean endpoint titer of linearity samples). The results show that the $10^{10}$ vp-dose immunizations with Ad4Ptr01-BB24.RSVF-2A-GLuc and Ad4Ptr13-BB21.RSVF-2A-GLuc both gave rise to RSV A2 neutralization titers.

Figure 6B:
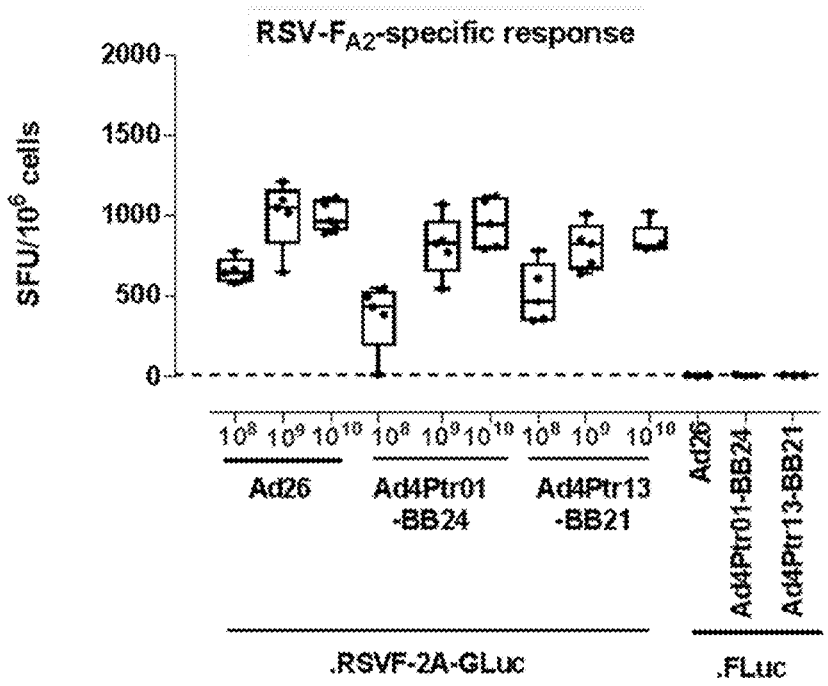

Induction of cellular immunity against the vector-encoded antigen was evaluated by an RSV-$F_{A2}$-specific ELISPOT assay. To this end, eight weeks after immunization, splenocytes from immunized mice were isolated and stimulated overnight with 15mer overlapping peptides spanning the RSV-$F_{24}$ protein and cellular immune responses were determined by ex-vivo ELISPOT assay measuring the relative number of IFN-γ-secreting cells. The data show that both Ad4Ptr13-BB21.RSVF-2A-Gluc and Ad4Ptr01-BB24.RSVF-2A-GLuc were able to elicit dose-dependent antigen-specific cellular immune responses (FIG. 6B). As expected, no RSV-F$_{A2}$-specific responses were measured from splenocytes of mice immunized with adenovectors encoding Firefly luciferase.

Figure 6C:
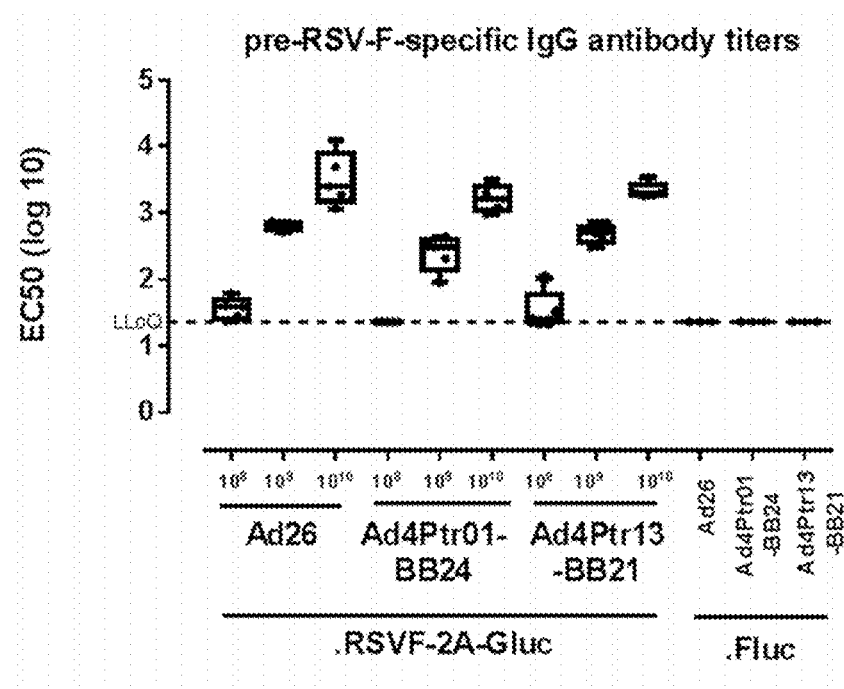

The ability of the RSVF-2A-GLuc-expressing vectors to elicit RSV-F$_{A2}$-specific IgG antibodies was assessed by ELISA. Sera collected 8 weeks post-immunization from the mice immunized with Ad26 (positive control), Ad4Ptr13-BB21, orAd4Ptr01-BB24 vectors expressing RSVF-2A-GLuc or Firefly luciferase were tested in an anti-RSV F$_{A2}$ IgG antibody ELISA. Specifically, this ELISA detects IgG antibodies capable of binding to a recombinant stable pre-fusion RSV-F$_{A2}$ protein (pre-RSV-F). The results show that both Ad4Ptr13-BB21.RSVF-2A-Gluc and Ad4Ptr01-BB24 were able to dose-dependently elicit pre-RSV-F-specific IgG antibody titers (FIG. 6C). As expected, no RSV-F$_{A2}$-specific titers were detected in sera from mice immunized with the vectors encoding Firefly luciferase only.

Altogether, the data show that the RSVF-2A-GLuc-expressing, novel engineered adenoviral vectors Ad4Ptr13-BB21 and Ad4Ptr01-BB24, which respectively comprise a BB21 fiber variant (SEQ ID NO:3) and the BB24 fiber (SEQ ID NO:4), were able to induce significant cellular and humoral immune responses against the encoded antigen. These immune responses clearly indicated good immunogenicity of Ad4Ptr13-BB21 and Ad4Ptr01-BB24 in mice.

Example 9: Evaluation of Serological Cross-Neutralization Among Novel and Existing Adenoviral Vectors For their potential utility as new adenoviral vaccine vectors, the novel adenoviral vectors created herein would preferably be serologically distinct from existing adenoviral vectors currently already in development as vaccine vectors, such as vectors based on human adenovirus serotypes HAdV-5 and HAdV-35. Therefore, cross-neutralization tests were performed among the novel adenoviral vectors BB21, BB24, Ad4Ptr13-BB21, and Ad4Ptr01-BB24 and several existing vectors based on HAdV-4, HAdV-5, HAdV-26, HAdV-35 and HAdV49. To this end, mice antisera, each raised against one of these adenoviral vectors, were tested against each of the different vectors in an adenovirus neutralization assay. The mice antisera used for this assay were collected from Balb/C mice two or eight weeks after their immunization with $10^{10}$ vector particles per mouse. The adenovirus neutralization assay was carried out as described previously (Spangers et al 2003. J. Clin. Microbiol. 41:5046-5052). Briefly, starting from a 1:16 dilution, the sera were 2-fold serially diluted, then pre-mixed with the adenoviral vectors expressing firefly luciferase (FLuc), and subsequently incubated overnight with A549 cells (at a multiplicity of infection of 500 virus particles per cell). Luciferase activity levels in infected cell lysates measured 24 hours post-infection represented vector infection efficiencies. Neutralization titers against a given vector were defined as the highest serum dilution capable of giving a 90% reduction of vector infection efficiency. The neutralization titers were arbitrarily divided into the following categories: <16 (no neutralization), 16 to 200, 200 to 2,000, and >2,000.

Figure 7:
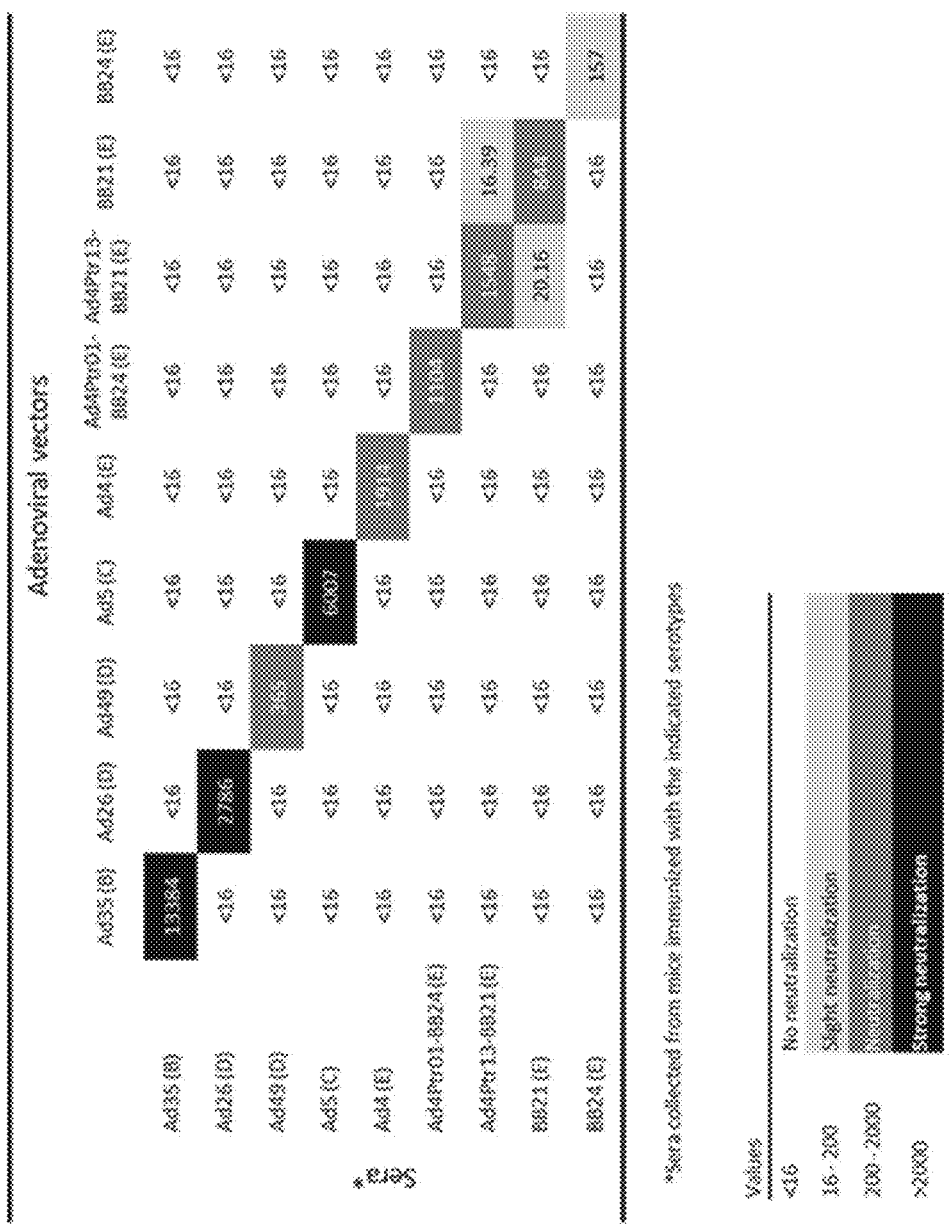
FIG. 7 shows homologous and heterologous adenovirus neutralization titers induced in mice immunized with adenoviral vectors Ad4, Ad5, Ad26, Ad35, Ad49, BB21, BB24, Ad4Ptr13-BB21, and Ad4Ptr01-BB24.

The results show no or very low levels of cross-neutralization among the vectors tested (FIG. 7). The only slight cross-neutralization that was observed was between vectors BB21 and Ad4Ptr13-BB21. The reciprocal cross-neutralization titers seen for these vectors were considerably lower than the respective homologous neutralization titers obtained for these same vectors. Importantly, none of the novel vectors (i.e. BB21, BB24, Ad4Ptr13-BB21, and Ad4Ptr01-BB24) displayed cross-neutralization with the human adenoviral vectors included in the tested panel, i.e. Ad26, Ad35, Ad49, Ad5 and Ad4. Therefore, the new adenoviral vectors BB21, BB24, Ad4Ptr13-BB21, and Ad4Ptr01-BB24 could each potentially be used in combination with one or more of these or other distinct adenoviral vectors in sequential immunizations, for example in the context of a heterologous prime-boost vaccination regimen or, alternatively or additionally, in the context of a series of two or more consecutive vaccination regimens against different diseases or antigens.

Example 10: Seroprevalence of Novel Adenoviral Vectors in Human Populations

Important for their potential use as efficacious vaccine vectors is that the novel adenoviral vectors described herein are not hampered by high levels of pre-existing anti-vector humoral immunity in vaccine target populations. Therefore, vectors BB21, BB24, Ad4Ptr13-BB21, and Ad4Ptr01-BB24 were each evaluated for their seroprevalence within 200 human cohort serum samples from adults, ages 18 to 55 years, living in the United States (US) and the European Union (EU). Each vector was tested for neutralization by the human serum samples by performing a standard adenovirus neutralization assay as carried out in Example 9 and described previously (Sprangers et al 2003. J. Clin. Microbiol. 41:5046-5052). Briefly, starting from a 1:16 dilution, the sera were 2-fold serially diluted, then pre-mixed with the adenoviral vectors expressing firefly luciferase (FLuc), and subsequently incubated overnight with A549 cells (at multiplicity of infection of 500 virus particles per cell). Luciferase activity levels in infected cell lysates, measured 24 hours post-infection, represented vector infection efficiencies. Neutralization titers against a given vector were defined as the highest serum dilution capable of giving a 90% reduction of vector infection efficiency. The neutralization titers were arbitrarily divided into the following categories: <16 (no neutralization), 16 to 300, 300 to 1000, 1000 to 4000 and >4000.

Figure 8:
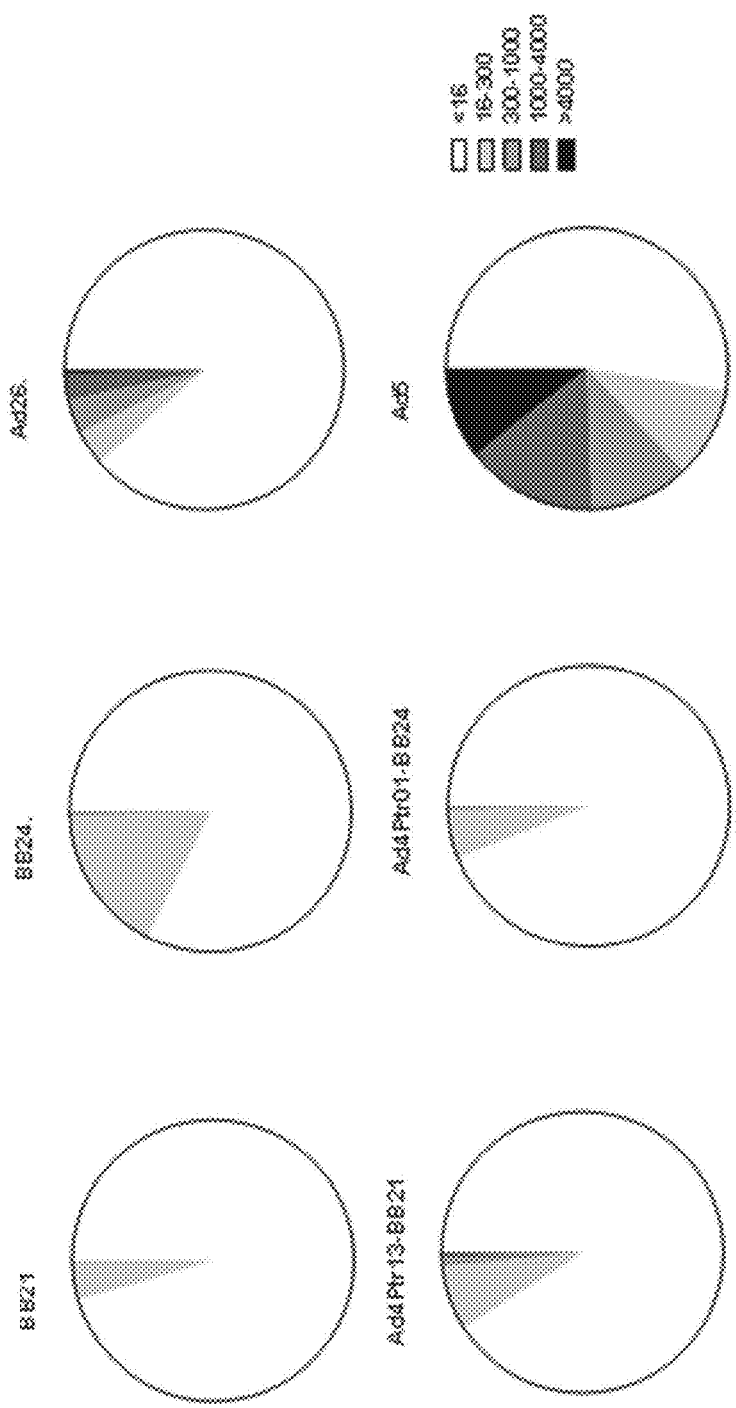
FIG. 8 shows the seroprevalence of Ad5, Ad26, BB21, BB24, Ad4Ptr13-BB21, and Ad4Ptr01-BB24 in 200 human cohort serum samples from adults, age 18 to 55 years, living in the United States (US) and European Union (EU). Neutralization titers measured in these sera against each vector were divided into four categories (<16 (negative), 16 to 300, 300 to 1,000, 1000 to 4000 and >4000), represented in the charts as indicated.

The results indicate that all four novel adenovirus vectors (i.e. BB21, BB24, Ad4Ptr13-BB21, Ad4Ptr01-BB24) have a considerably lower seroprevalence in the human subjects studied than the control Ad5 vector (FIG. 8). Furthermore, vectors BB21, Ad4Ptr13-BB21, and Ad4Ptr01-BB24 additionally displayed a lower seroprevalence than the benchmark Ad26 vector. Moreover, the positive neutralization titers that were seen against the novel vectors were generally quite low, mostly not higher than 300. By contrast, most of the positive neutralization titers found against Ad26 and Ad5 were higher than 300.

Altogether, the above data indicate that pre-existing humoral anti-vector immunity against vectors BB21, BB24, Ad4Ptr13-BB21, and Ad4Ptr01-BB24 can be considered to be low in the evaluated vaccine target populations, suggesting that these vectors have potential as efficacious vaccine vectors in these populations.

Example 11: Adenoviral Vector Productivity in Suspension PER.C6 Cells

Adenovirus vectors to be used in clinical trials and beyond need to be readily producible to high titers in a scalable, serum-free adenovirus production platform. Suspension-adapted PER.C6® cells, also referred to herein as suspension PER.C6 cells or sPER.C6, represent such a platform as they have been shown to support large-scale manufacturing of adenoviral vectors in bioreactors, achieving large quantities of high-titer, clinical grade vector preparations, e.g. of E1-deleted vectors based on HAdV-26 or HAdV-35 (EP 2536829 B1, EP 2350268 B1).

As an initial assessment as to whether the novel vectors described herein would fit sPER.C6 cell-based production processes, small-scale vector productivity experiments were performed on sPER.C6 cells cultured in shaker flasks. These productivity experiments were carried out using the Fluc-encoding versions of the novel vectors described in Examples 1 and 2. Taken along as a benchmark control was the HAdV-26-based vector Ad26.Fluc. Suspension PER.C6 cell cultures, seeded into shaker flasks at a density of $1\times10^6$ cells/ml in a total volume of 10 ml of PERMEXCIS® medium (available from Lonza) supplemented with 4 mM L-Glutamine (Lonza), were infected with the different vectors at different virus particle (VP)-to-cell ratios and then incubated for 4 days. The different VP-to-cell ratios used for infection were 70, 150 and 900. Samples of the infected cell cultures were taken every day and VP titers were determined in these samples by a quantitative PCR (qPCR)-based protocol that employs primers and probe that are specific for the CMV promoter (which is present in all the vectors tested). This protocol entails a DNAse treatment of the test samples prior to the qPCR to remove any free vector DNA (i.e. vector genomes that are not packaged into viral particles).

Figure 17:
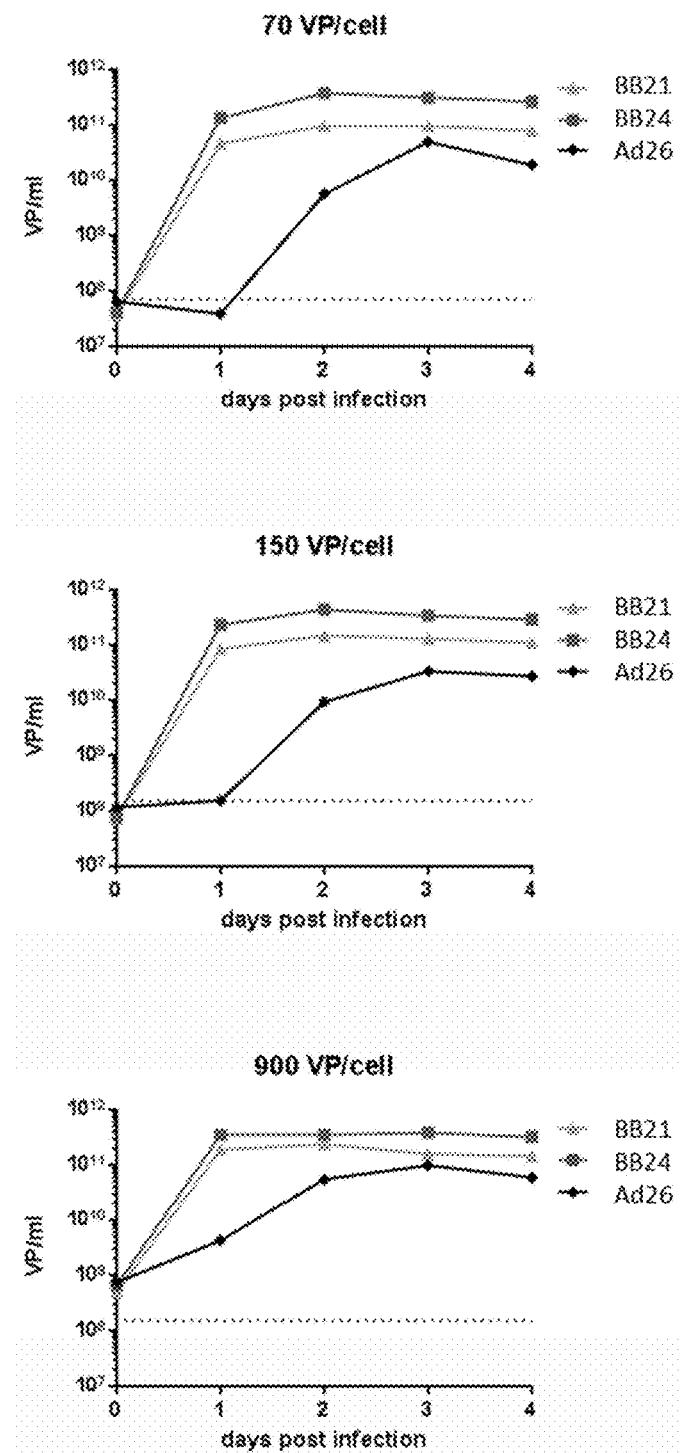
FIG. 17 shows productivity of novel vectors BB21.Fluc and BB24.Fluc in production cell line sPER.C6.
Figure 18:
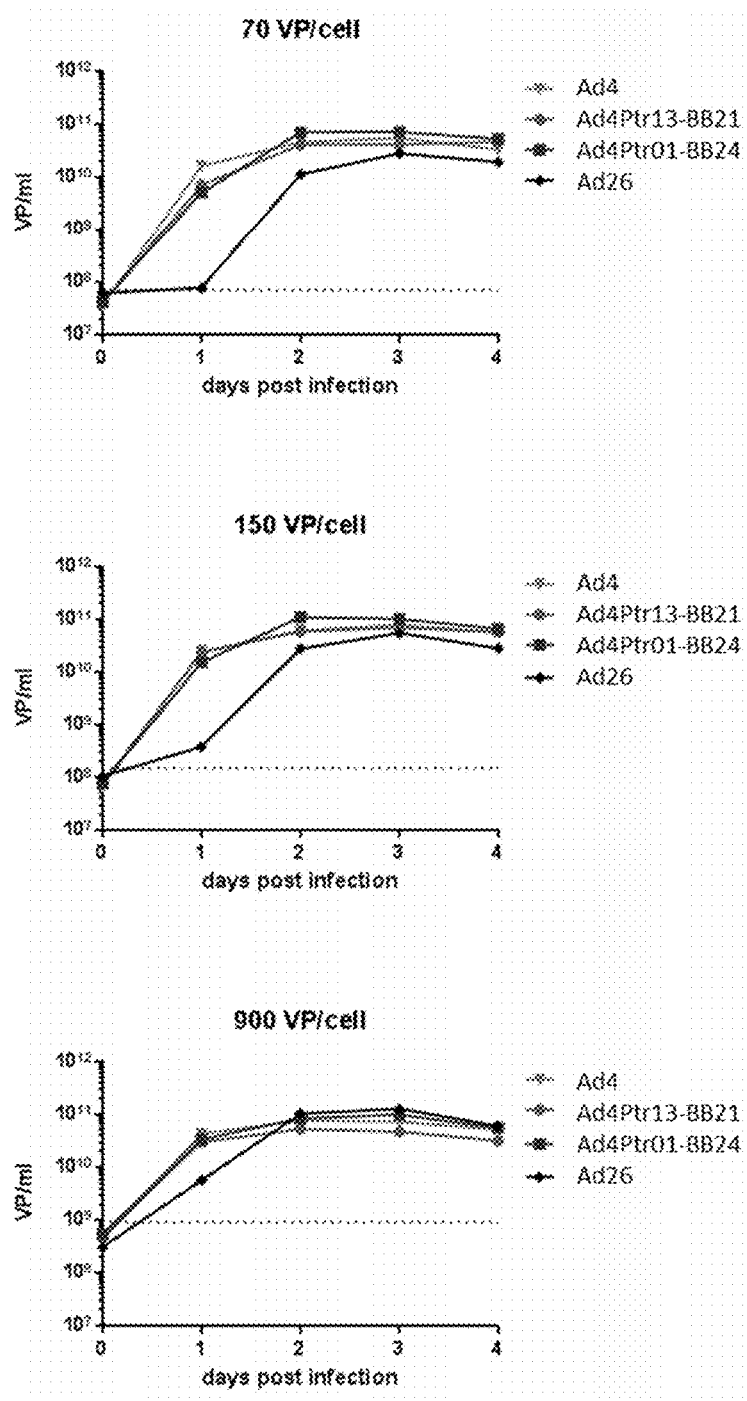
FIG. 18 shows productivity of novel capsid-chimeric vectors Ad4Ptr13-BB21 and Ad4Ptr01-BB24 in production cell line sPER.C6.

The productivity results obtained for novel vectors BB21.FLuc and BB24.Fluc are shown in FIG. 17 while those seen for the new chimeric vectors Ad4Ptr01-BB24.FLuc and Ad4Ptr13-BB21.FLuc, as well as their parental vector Ad4.Fluc, are presented in FIG. 18. BB21.FLuc and BB24.Fluc displayed higher VP titers than the benchmark control vector Ad26.Fluc at all VP-to-cell infection ratios and harvest time points tested. Likewise, the two chimeric vectors Ad4Ptr01-BB24.FLuc and Ad4Ptr13-BB21.FLuc displayed good productivities, yielding VP titers that were either higher than or appearing equivalent to those obtained for Ad26.Fluc (depending on the VP-to-cell infection ratio used). Additionally, these two chimeric vectors showed uncompromised productivities compared to the parental, non-capsid-modified vector Ad4.Fluc.

The above results demonstrate good productivity of each of the novel vectors on a sPER.C6-based, serum-free suspension cell culture model.

Collectively, the studies of humoral and cellular immune responses induced by the novel recombinant adenoviral vectors of the invention, as presented above, clearly indicate potent immunogenicity of these vectors in mice. In addition, the vectors demonstrated to induce no cross-neutralizing antibody responses against certain existing adenoviral vaccine vector candidates (e.g. Ad26 and Ad35) or vice versa, as well as no, or very low, cross-neutralizing antibody responses against each other. Furthermore, the new vectors showed low seroprevalence in humans. Finally, the new vectors can be readily produced at high yields. The combination of low seroprevalence, potent immunogenicity and producibility suggests that the novel adenoviral vectors of the invention can be useful as novel vaccine vector candidates against a variety of pathogens and may additionally have utility in gene therapy and/or diagnostics.

It will be appreciated by those skilled in the art that changes could be made to the embodiments described above without departing from the broad inventive concept thereof. It is understood, therefore, that this invention is not limited to the particular embodiments disclosed, but it is intended to cover modifications within the spirit and scope of the present invention as defined by the present description.

SEQUENCE LISTING (64 sequences)

SEQ ID NO: 1 - protein, 370 aa, Artificial Sequence
  Amino Acids 6-375 of Fiber Polypeptide
ARVDDGFDPVYPYDADNAPTVPFINPPFVSSDGFQEKPLGVLSLRLADPVTTKNGAVTLKLGEGVDLDDSGKLISKNATKATAPLSISNNTISLNMDAPLYNNNGKLGIRIGAPLKVVDLLNTLAVAYGSGLGLKNNALTVQLVSPLTFDNKGNVKINLGNGPLTVAANRLSVTCKRGLYVTTTGDALESNISWAKGIRFEGNAIAANIGKGLEFGTTSSESDVSNAYPIQVKLGTGLTFDSTGAIVAWNKEDDKLTLWTTADPSPNCKIYSEKDAKLTLCLTKCGSQILGTVTVLAVNNGSLNPITNAVSTAIVYLKFDANGVLLSNSTLNKEYWNFRKGDVTPAEAYTNAIGFMPNIKAYPKNTNVAS

SEQ ID NO: 2 - protein, 440 aa, Artificial Sequence
  BB21 Fiber
MSKKRARVDDGFDPVYPYDADNAPTVPFINPPFVSSDGFQEKPLGVLSLRLADPVTTKNGAVTLKLGEGVDLDDSGKLISKNATKATAPLSISNNTISLNMDAPLYNNNGKLGIRIGAPLKVVDLLNTLAVAYGSGLGLKNNALTVQLVSPLTFDNKGNVKINLGNGPLTVAANRLSVTCKRGLYVTTTGDALESNISWAKGIRFEGNAIAANIGKGLEFGTTSSESDVSNAYPIQVKLGTGLTFDSTGAIVAWNKEDDKLTLWTTADPSPNCKIYSEKDAKLTLCLTKCGSQILGTVTVLAVNNGSLNPITNAVSTAIVYLKFDANGVLLSNSTLNKEYWNFRKGDVTPAEAYTNAIGFMPNIKAYPKNTNVASKSHIVGQVYLNGDETKPLMLIITFNETDDATCTYCITFQWKWDNSKYTGETLATSSFPFSYIAQE

SEQ ID NO: 3 - protein, 440 aa, Artificial Sequence
  BB21 fiber variant
MSKKRARVDDGFDPVYPYDADNAPTVPFINPPFVSSDGFQEKPLGVLSLRLADPVTTKNGAVTLKLGEGVDLDDSGKLISKNATKATAPLSISNNTISLNMDAPLYNNNGKLGIRIGAPLKVVDLLNTLAVAYGSGLGLKNNALTVQLVSPLTFDNKGNVKINLGNGPLTVAANRLSVTCKRGLYVTTTGDALESNISWAKGIRFEGNAIAANIGKGLEFGTTSSESDVSNAYPIQVKLGTGLTFDSTGAIVAWNKEDDKLTLWTTADPSPNCKIYSEKDAKLTLCLTKCGSQILGTVTVLAVNNGSLKPITNAVSTAIVYLKFDANGVLLSNSTLNKEYWNFRKGDVTPAEAYTNAIGFMPNIKAYPKNTNVASKSHIVGQVYLNGDETKPLMLIITFNETDDATCTYCITFQWKWDNSKYTGETLATSSFPFSYIAQE

SEQ ID NO: 4 - protein, 440 aa, Artificial Sequence
  BB24 Fiber
MSKKRARVDDGFDPVYPYDADNAPTVPFINPPFVSSDGFQEKPLGVLSLRLADPVTTKNGAVTLKLGEGVDLDDSGKLISKNATKATAPLSISNNTISLNMDAPLYNNNGKLGIRIEAPLQVVDLLNTLVVAYGSGLGLKNNALTVQLVSPLTFDNKGNVKINLGNGPLTVAANRLSVTCKRGLYVTTTGDALESNISWAKGIRFEGNAIAANIGKGLEFGTTSSESDVSNAYPIQVKLGTGLTFDSTGAIVAWNKEDDKLTLWTTADPSPNCKIYSEKDAKLTLCLTKCGSQILGTVTVLAVNNGSLNPITNIVSTAIVYLKFDANGVLLSNSTLNKEYWNFRKGDVTPAEAYTNAIGFMPNIKAYPKNTNVASKSHIVGQVYLNGDETKPLMLIITFNETDDETCTYCITFQWKWDNSKYTGETLATSSFPFSYIAQE

SEQ ID NO: 5 - protein, 298 aa, Artificial Sequence
  BB21 HVRs
NENNGQGQAKTHTYGVAAMGGLDITKEGLQIGTDASKKNDNEIYADKTYQPEPQIGEENWQDTENFYGGRALKKDTKMKPCYGSFARPTNVKGGQAKVKTEENVQSFDINLAFFDIPSTGTGGNGTNVDDKPDMVMYTENVNLETPDTHIVYKPGTSDDSSEANLCQQAMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGAGTNAVYQGVKEKTGNNGKWEADTNVASQ

SEQ ID NO: 6 - protein, 306 aa, Artificial Sequence
  BB24 HVRs
AKTGNNNGNGGTESVTFGVAAMGGGNITKEGLQIGSDETKTDNKEIYADKTYQPEPQIGEENWQETFSFYGGRALKKDTKMKPCYGSFARPTNEKGGQAKFKVQDGQQTTDYDIDLAFFDIPNSGTGGNGTNVNYDPDMVMYTENVNLETPDTHVVYKPGTSDDSSEANLLQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGAGTNAVYQGVKAKDNGNAANGNWEKDTDVSSI

SEQ ID NO: 7 - protein, 938 aa, Artificial Sequence
  BB21 hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQNENNGQGQAKTHTYGVAAMGGLDITKEGLQIGTDASKKNDNEIYADKTYQPEPQIGEENWQDTENFYGGRALKKDTKMKPCYGSFARPTNVKGGQAKVKTEENVQSFDINLAFFDIPSTGTGGNGTNVDDKPDMVMYTENVNLETPDTHIVYKPGTSDDSSEANLCQQAMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGAGTNAVYQGVKEKTGNNGKWEADTNVASQNQICKGNIYAMEINLQANLWRSFLYSNVALYLPDSYKYTPANITLPTNTNTYDYMNGRVVPPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 8 - protein, 946 aa, Artificial Sequence
  BB24 hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQAKTGNNNGNGGTESVTFGVAAMGGGNITKEGLQIGSDETKTDNKEIYADKTYQPEPQIGEENWQETFSFYGGRALKKDTKMKPCYGSFARPTNEKGGQAKFKVQDGQQTTDYDIDLAFFDIPNSGTGGNGTNVNYDPDMVMYTENVNLETPDTHVVYKPGTSDDSSEANLLQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGAGTNAVYQGVKAKDNGNAANGNWEKDTDVSSINQICKGNIYAMEINIQANLWRSFLYSNVALYLPDSYKYTPANITLPTNTNTYDYMNGRVVPPSLVDAYINIGARWSLDPMDNVNPFNHHRNAGLRYRSMLLGNGRFVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 9 - DNA, 2805 bp, Artificial Sequence
  Ptr01 hexon
atggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaatgctctggctcctaaagctgctcctaatccaagtcaatgggaagaaacttccacagatgctactactactactactcacagctttggcctggctgctatgaagggggacaatattacatctgacggtttgcagataggaacagatgctacttctggagaggaaaaacccatctatgcagataaactgtaccagccagaaccccaaataggggaagagtcatggactgatactgacggaaccaatgaaaaattcggaggaagagtccttaaaaaggacacaagcatgaaaccctgctacgggtcatttgccaagccaaccaataacaaaggtgggcaggcaaaacaaaaggcaacggaaggaaccactgtagaatatgatgttgacatgaacttttttgatggtagagatgcagctgctaactttactccagaagtagtgttgtatgctgaaaatgttgatttggaaactccagatacacatattgtatacaagccaggaacctcagatgtgagttcccatgtcaatttgggtcagcaagccatgcccaacagacccaactacattgggttcagggacaactttattgggctgatgtactacaacagcactggcaatatgggtgtgctggccggtcaggcctctcagctgaatgctgtggttgacttgcaagacagaaacaccgaactgtcttaccagctcttgcttgactctctgggtgacagaacccggtacttcagtatgtggaatcaggcggtggacagttatgatcctgatgtgcgcattattgaaaatcatggtatagaagatgagcttcccaactattgcttccccattgacgctgtgggtattactaaaacttatcaaggtatcaaaacgcaaaatggtcaaactacaacgtgggaaaaggacaccagtgttagtacggccaatgaaataggcattggcaacaatcttgctatggaaatcaacatccaagccaacctctggaggaacttcctctatgccaacgtggccctgtacctgcccgactcttacaagtacacgccggccaacgtcactctgcccaccaacaccaatacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataa

SEQ ID NO: 10 - protein, 934 aa, Artificial Sequence
  Ptr01 hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNALAPKAAPNPSQWEETSTDATTTTTHSFGLAAMKGDNITSDGLQIGTDATSGEEKPIYADKLYQPEPQIGEESWTDTDGTNEKFGGRVLKKDTSMKPCYGSFAKPTNNKGGQAKQKATEGTTVEYDVDMNFFDGRDAAANFTPEVVLYAENVDLETPDTHIVYKPGTSDVSSHVNLGQQAMPNRPNYIGFRDNFIGLMYYNSTGNMGVLAGQASQLNAVVDLQDRNTELSYQLLLDSLGDRTRYFSMWNQAVDSYDPDVRIIENHGIEDELPNYCFPIDAVGITKTYQGIKTQNGQTTTWEKDTSVSTANEIGIGNNLAMEINIQANLWRNFLYANVALYLPDSYKYTPANVTLPTNTNTYDYMNGRVVAPSLVDSYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFICDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 11 - DNA, 2829 bp, Artificial Sequence
  Ptr13 hexon
atggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagcacccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccaccaatgaaaagggaggacaggctaaacttaaagttggagatgatggagttccaaccaaagaatttgacatagacctggctttctttgatactcccggtggcactgtgaatggccaagatgagtataaagcagacattgtcatgtataccgaaaacgcctatctggaaactccagacacacatgtggtatacaaaccaggcaaggaagatgcaagttctgaaattaacctggttcagcagtccatgcccaacagacccaactacattgggttcagggacaactttattggtctcatgtattacaacagcactggcaatatgggggtgctggccggtcaggcctcacagctgaatgctgtggttgacttgcaagacagaaacactgagctgtcctaccagctcttgcttgactctctgggtgacagaacccggtatttcagtatgtggaatcaggcggtggacagttatgatcctgatgtgcgcattattgaaaaccatggtgtggaggatgaactgccaaactattgcttccccttggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggaaatcaacctccaagccaacctgtggaggagtttcctctactcgaacgtggccctgtacctgcccgactcttacaagtacacgccggccaacgtcaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataa

SEQ ID NO: 12 - protein, 942 aa, Artificial Sequence
  Ptr13 hexon
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQAKPGNGGTMETHTYGVAPMGGENITKDGLQIGTDATADQNKPIYADKTFQPEPQVGEENWQETESFYGGRALKKDTNMKPCYGSYARPTNEKGGQAKLKVGDDGVPTKEFDIDLAFFDTPGGTVNGQDEYKADIVMYTENAYLETPDTHVVYKPGKEDASSEINLVQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGSGTNAAYQGVKVKNGEDGDLESEWENDDTVAARNQICKGNIFAMEINLQANLWRSFLYSNVALYLPDSYKYTPANVTLPTNTNTYDYMNGRVVAPSLVDSYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFICDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 13 - DNA, 36640 bp, Artificial Sequence
  BB21 genome
catcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacgtaggtgtcagctgatcgccagggtatttaaacctgcgctctctagtcaagaggccactcttgagtgccagcgagtagagttttctcctccgcgccgcgagtcagatctacactttgaaagatgaggcacctgagagacctgcccggtaatgttttcctggctactgggaacgagattctggaactggtggtggacgccatgatgggtgacgaccctcctgagccccctaccccatttgaggcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagctcgacctgcgctgctatgaggaatgcttgcctccgagcgatgatgaggaggacgaggaggcgattcgagctgcagcgagcgagggagtgaaagctgcgggcgagagctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagttgggaaggcagagggtgactgggtgctgactggtttatttatgtatatgttttttatgtgtaggtcccgtctctgacgcagatgagacccccacttcagagtgcatttcatcacccccagaaattggcgaggaaccgcccgaagatattattcatagaccagttgcagtgagagtcaccgggcggagagcagctgtggagagtttggatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgcgtggtttatgacttaggggtggagactgtgggtatataagcaggtgcagacctgtgtggtcagttcagagcaggactcatggagatctggacggtcttggaagactttcaccagactagacagctgctagagaactcatcggagggagtctcttacctgtggagattctgtttcggtgggcctctagctaagctagtctatagggccaagcaggattataaggatcaatttgaggatattttgagagagtgtcctggtatttttgactctctcaacttgggccatcagtctcactttaaccagagtattctgagagcccttgacttttccactcctggcagaactaccgccgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaggaggaccgagaagagaacccgagagccggtctggaccctccggtggcggaggaggaggagtagctgacttgtttcccgagctgcgtcgggtgctgactaggtcttccagtggacgggagagggggattaagcgggagaggcatgaggagactagccacagaactgaactgactgtcagtctgatgagccgcaggcgcccagaatcggtgtggtggcatgaggtgcagtcgcaggggatagatgaggtctcggtgatgcatgagaaatattccctagaacaagtcaagacttgttggttggagcctgaggatgattgggaggtagccatcaggaattatgccaagctggctctgaagccagacaagaagtacaagattactaagctgataaatatcagaaatgcctgctacatctcagggaatggggctgaagtggagatctgtcttcaggaaagggtggctttcagatgctgcatgatgaatatgtacccgggagtggtgggcatggatggggtcacctttatgaacatgaggttcaggggagatgggtataatggcacggtctttatggccaataccaagctgacagtccatggctgctccttctttgggtttaataacacctgcatcgaggcctggggtcaggtggctgtaaggggctgcagtttttcagccaactggatgggggtcgtgggcaggaccaagagtatgctgtctgtgaagaaatgcttgttcgagaggtgtcacctgggggtgatgagcgagggcgaagccagaatccgccactgtgcctctactgagacgggctgcttcgtgctgtgcaagggcaatgctaagatcaagcataatatgatttgtggagcctcggatgagcgcggctaccagatgctgacctgcgccggggggaacagccatatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaagatggcatgcgagttggaggagatggtgggcctttggaagatgttgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatttgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcgaaagggttggggcacctcggcccggttgttgatgacctgggcggcgagcacgatctcgtcgaagccgttgatgttgtggcccacgatgtaaagttccacgaatcgcgggcggcccttgacgtggggcagtttcttgagctcctcgtaggtgagctcgtcggggtcgctgagtccgtgctgctcgagcgcccagtcggcgagatgggggttggcgcggaggaaggaagtccaaagatccacggccagggcggtttgcaggcggtcccggtattgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagtggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgcttcggcttccatgtcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccagccgctccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctcctcttcttcttccacctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatatagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgtttttttggccttggtcactggtcatgaaaaactagtaagcgcggaaagcgaccgcccgcgatggctcgctgccgtagtctggagaaagaatcgccagggttgcgttgcggtgtgccccggttcgagcctcggcgctcggcgccggccggattccgcggctaacgtgggcgtggctgccccgtcgtttccaagaccccttagccagccgacttctccagttacggagcgagcccctctttttttcttgtgtttttgccagatgcatcccgtactgcggcagatgcgcccccaccctccaccacaaccgcccctaccgcagcagcagcagcagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcgtcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcatgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaagtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcaaaagatcccaccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccggccgcgagggtgctgccgcggcggttcccgaggccgccagtcctttcccgagcttgcccttctcgctgaacagtattcgcagcagcgagctggggaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccacgagccggggcagcgccgcccgtaaacgccggtggcacgacaggcagcgggggctgatgtgggacgatgaggattccgccgacgacagcagcgtgttggacttgggtgggagtggtggtaacccgttcgctcacctgcgcccccgcatcgggcgcatgatgtaagagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatacgtatgatggtagtcaggatatcttggagtatgaatgggtggagtttgagctacccgaaggcaacttctcggtgaccatgaccatcgacctgatgaacaacgccatcatcgacaattacttggcggtggggcggcagaacggggtcctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtgcgcccgcccgcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcttgcgcgcgcccagcaagatgtacggaggcgctcgccaacgctccacgcaacaccccgtgcgcgtgcgcgggcacttccgcgctccctggggtgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacggactggtggagtttgtgcgcgagttcgcccccaggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaaaatccccacggagcccatggaaacacagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatcaatggccctcacatgccgcctccgcgttcccattacgggctaccgaggaagaaaaccgcgccgtagaaggctggcggggaacgggatgcgtcgccaccaccaccggaggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgaaccgcccccgtacgaggaggcggtgaaactgggtctgcccaccacgcggcccatcgcgcccctggccaccggggtgctgaaacccgaaaagcccgcgaccctggacttgcctccgccttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaattccagccagtgggagcaaaatgaaaacaatggtcaaggtcaagctaagacacacacctatggtgttgctgctatgggcggacttgatattacaaaagagggtcttcaaattggaactgatgctagtaagaaaaatgacaatgaaatttatgccgataaaacatatcagccagagcctcaaataggagaggaaaattggcaagacactgaaaacttttatggaggcagagctcttaaaaaagataccaagatgaagccatgctatggctcatttgccagacctaccaatgtgaagggagggcaagccaaagtgaaaacagaagaaaatgttcagtcattcgacataaatctggctttctttgatattccaagcaccggcacggggggcaatggtacaaatgtagatgataagccagacatggtcatgtacactgaaaatgtgaatctggagacgccagatactcatattgtgtacaaacctggaacttcagatgacagctctgaagccaacttgtgccagcaggccatgccaaacagacctaactacattggtttcagagacaactttattgggctcatgtattacaacagtactggcaatatgggggtgctggctggtcaggcctctcagttgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaaccacggtgtggaagatgaacttcccaactattgcttcccattggatggagctggtactaatgctgtttaccagggtgttaaagaaaaaactggcaataatggcaagtgggaagcagataccaatgttgcctctcagaaccagatatgcaagggtaacatctatgccatggaaatcaacctccaagccaacctgtggagaagttttctctactcgaacgtggccctgtacctgcccgattcttacaagtacacgccggccaacatcaccctgcccactaacaccaatacctatgattacatgaacgggagagtggtgcctccctcgctggtggacgcctacatcaacatcggggcgcgctggtcgttggaccccatggacaacgtcaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccactcatcggcaaaagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgctacttgcatgatgactgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaacaatcaagacatgtaacactgtgtgtatgtttaaaatatctttaataaacagcactttaatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccattccgaagggggtcatcttgcaggtctgccttcccatagtgggcacgcacccgggcttgtggttgcaatcgcagtgcagggggatcagcatcatctgggcctggtcggcgttcattcccgggtacatggccttcatgaacgcctccaattgcctgaacgcctgctgggccttggctccctcggtgaagaagaccccgcaggacttgctagagaactggttggtagcgcacccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggtctcggtgcatccgtgcagccacagcgcgcacccggtgcactcccagttcttgtgggcgatctgggaatgcgcgtgcacgaacccctgcaggaagcggcccatcatggtcgtcagggtcttgttgctagtgaaggtcagcgggatgccgcggtgctcctcgttgatgtacaggtagcagatgcggcggtacacctcgccctgctcgggcatcagctggaagttggctttcaggtcggtctccacgcggtagcggtccatcagcatagtcatgatttccatgcccttctcccaggccgagacgatgggcaggctcatagggttcttcaccatcatcttagcactagcagccgcagccagggggtcgctctcgtccagggtctcaaagctccgcttgccgtccttctcggtgatccgtaccggggggtagctgaagcccacggccgccagctcctcctcggcctgcctttcgtcctcgctgtcctggctgacgtcctgcaggaccacatgcttggtcttgcggggtttcttcttgggcggcagcggcggcggagatgctggagatggcgagggggagcgcgagttctcgctcaccactactatctcttcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagaatgaaagcttaaccgccccgccgcccagccccgcctccgacgcgcccgtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccgacaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgcatccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcgcgacctttctgaatctaataccacccacaccggaggtgagctccgaggtcgaccaacctctgggatttactacggcccctgggaggtggtagggttaatagcgctaggcctagttgcgggtgggcttttggctctctgctacctatacctcccttgctgttcttacttagtggtgctgtgttgctggtttaagaaatggggaagatcaccctagtgagctgcggtgtgctggtggcggtggtgctttcgattgtgggactgggcggcgcggctgtagtgaaggagaaggccgatccctgcttgcatttcaatcccgacaaatgccagctgagttttcagcccgatggcaatcggtgcgcggtagtgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcgcacatgtgcgacacggtcatgtggatgagcaagcagtacgatatgtggccccccacgaaggagaacatcgtggtcttctccatcgcttacagcctgtgcacggcgctaatcaccgctatcgtgtgcctgagcattcacatgctcatcgctattcgccccagaaataatgccgaaaaagaaaaacagccataacacgttttttcacacacctttttcagaccatggcctctgttactgccctaactatttttttgggccttgtgggcactagcagcacttttcagcatataaacaaaactgtttatgctggttctaattctgtattacctgggcatcaatcacaccagaaagtttcatggtactggtatgataaaagtaacacgccagtcacactctgcaagggtcatcaaacacccataaaccgtagtggaattttttttaaatgtaatcataataatattacactactttcaattacaaagcactattctggtacttactatggaaccaattttaacataaaacaggacacttactatagtgtcacagtattggatccaactactcctagaacaacaaaacccacaactactaagaggcacactaaacctaaaactaccaagaaaaccactgtcaaaactacaacaactaggaccaccacaactacagaggctaccaccagcacaacacttgctgccactacacacacacacactgagctaaccttacagaccactaatgatttgatcgccctgctgcaaaagggggataacagcaccacttccaatgaggagatacccaaatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggcctttttagtttttctatcattacctctgctctttgtgaatcagtggataaagatgttactattaccactggttctaattatacactgaaagggccaccctcaggtatgctttcgtggtattgctattttggaactgacactgatcaaactgaattatgcaattttcaaaaaggcaaaacctcaaactctaaaatctctaattatcaatgcaatggcactgatctgatactactcaatgtcacgaaagcatatggtggcagttattattgccctggacaaaacactgaagaaatgattttttacaaagtggaagtggttgatcccactacaccacccaccaccacaactattcataccacacacacagaacaaacaccagaggcaacagaagcagagttggccttccaggttcacggagattcctttgctgtcaatacccctacacccgatcagcggtgtccggggccgctagtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcgctctagttttttgttctttgattggcattgtttttaatagtaaaattaccagagttagctttattaaacatgttaatgtaactgaaggagataacatcacactagcaggtgtagaaggtgctcaaaacaccacctggacaaaataccatctaggatggagagatatttgcacctggaatgtaacttattattgcataggagttaatcttaccattgttaacgctaaccaatctcagaatgggttaattaaaggacagagtgttagtgtgaccagtgatgggtactatacccagcatagttttaactacaacattactgtcataccactgcctacgcctagcccacctagcactaccacacagacaaccacatacagtacatcaaatcagcctaccaccactacagcagcagaggttgccagctcgtctggggtccgagtggcatttttgatgttggccccatctagcagtcccactgctagtaccaatgagcagactactgaatttttgtccactgtcgagagccacaccacagctacctccagtgccttctctagcaccgccaatctctcctcgctttcctctacaccaatcagccccgctactactcctagccccgctcctcttcccactcccctgaagcaaacagacggcggcatgcaatggcagatcaccctgctcattgtgatcgggttggtcatcctggccgtgttgctctactacatcttctgccgccgcattcccaacgcgcaccgcaagccggcctacaagcccatcgttatcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcgtcacctgcatctgctgctgtagcatagtctgcctgcttatcaccttcttccagttcattgactggatctttgtgcgcatcgcctacctgcgccaccacccccagtaccgcgaccagcgagtggcgcagctgctcaggctcctctgataagcatgcgggctctgctacttctcgcgcttctgctgttagtgctcccccgtcccgtcgacccccggtcccccactcagtcccccgaggaggttcgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcagcaacctcaggcacacgcactaccaccaccacagcctaggccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaattcgagtagttattttccctcctccctcccaactcatggaatacaccaccctctccccacgcacagccttaaacatctgaatgccattggtaatggacatggttttggtctccacattccacacagtttcagagcgagccagtctcgggtcggtcagggagatgaaaccctccgggcactcctgcatctgcacctcaaagttcagtagctgagggctgtcctcggtggtcgggatcacagttatctggaagaagagcgatgagagtcataatccgcgaacgggatcgggcggttgtggcgcatcaggccccgcagcagtcgctgtctgcgccgctccgtcaagctgctgctcaaggggtccgggtccagggactccctgcgcatgatgccgatggccctaagcatcagtcgcctggtgcggcgggcgcagcagcggatgcggatctcactcaggtcgctgcaatacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaacacgctgcccatgtacatgatctccttgggcatgtggcggttcaccacctcccggtaccacatcaccctctggttgaacatgcagccccggatgatcctgcggaaccacagggccaacaccgccccgcccgccatgcagcgaagagaccccgggtcccggcaatggcaatggaggacccaccgctcgtacccgtggatcatctgggagctgaacaagtctatgttggcacagcacaggcacacgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggtcgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcagaattcgactttcaaattccgtcgaccgttaaaaacgtcacccgccccgcccctaacggtcgccttcgtcacagccaatcaccttcctccctccccaaattcaaacacctcatttgcatattaacgcgcaccaaaagtttgaggtatattattgatgatg

SEQ ID NO: 14 - DNA, 36728 bp, Artificial Sequence
  BB24 genome
catcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtaggtgtcagctgatcgccagggtatttaaacctgcgctctctagtcaagaggccactcttgagtgccagcgagtagagttttctcctccgcgccgcgagtcagatctacactttgaaagatgaggcacctgagagacctgcccggtaatgttttcctggctactgggaacgagattctggaactggtggtggacgccatgatgggtgacgaccctccggagccccctaccccatttgaggcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagctcgacctgcgctgctatgaggaatgcttgcctccgagcgatgatgaggaggacgaggaggcgattcgagctgcagcgaaccagggagtgaaagcggcgggcgagggctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagttgggaaggcagagggtgactgggtgctgactggtttatttatgtatatgtttttttatgtgtaggtcccgtctctgacgtagatgagacccccacttcagagtgcatttcatcacccccagaaattggcgaggaaccgcccgaagatattattcatagaccagttgcagtgagagtcaccgggcggagagcagctgtggagagtttggatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgcgtggtttatgactcaggggtggggactgtgggtatataagcaggtgcagacctgtgtggtcagttcagagcaggactcatggagatctggacggtcttggaagactttcatcagactagacagctgctagagaactcatcggaggaagtctcttacctgtggagattttgcttcggtggggctctagctaagctagtctatagggccaaacaggattataaggatcaatttgaggatattttgagagagtgtcctggtatttttgactctctcaacttgggccatcagtctcactttaaccagagtattctgagagcccttgacttttctactcctggcagaactaccgccgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaggaggatcgagaagagaacccgagagccggtctggaccctccggtggcggaggaggaggagtagctgacttgtttcccgagctgcgtcgggtgctgactaggtcttccagtggacgggagagggggattaagcgggagaggcatgaggagactagccacagaactgaactgactgtcagtctgatgagccgcaggcgcccagaatcggtgtggtggcatgaggtgcagtcgcaggggatagatgaggtctcggtgatgcatgagaaatattccctagaacaagtcaagacttgttggttggagcctgaggatgattgggaggtagccatcaggaattatgccaagctggctctgaagccagacaagaagtacaagattactaagctgataaatatcagaaatgcctgctacatctcagggaatggggctgaagtggagatctgtcttcaggaaagggtggctttcagatgctgcatgatgaatatgtacccgggagtggtgggcatggatggggtcacctttatgaacatgaggttcaggggagatgggtataatggcacggtctttatggccaataccaagctgacagtccatggctgctccttctttgggtttaataacacctgcatcgaggcctggggtcaggtggctgtaaggggctgcagtttttcagccaactggatgggggtcgtgggcaggaccaagagtatgctgtctgtgaagaaatgcttgttcgagaggtgtcacctgggggtgatgagcgagggcgaagccagaatccgccactgtgcctctactgagacgggctgcttcgtgctgtgcaagggcaatgctaagatcaagcataatatgatttgtggagcctcggatgagcgcggctaccagatgctgacctgcgccggggggaacagccatatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcacttaggttgtcagtttctagaaacgaggaggatttgatattgacggtgccggcggagatgcctttcaagagcccctcgtccatctggtcagaaaagacgatctttttattgtcgagtttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtaggggctgaggggcgtgccccatggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcggctgggcttttcggcacggtagacgatctggcggaagatggcatgcgagttggaggagatggtgggcctttggaagatattgaagtgggcgtggggcaggccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatatagaactggttgacggccttgtaggcacagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaaaccgttgatgttgtggcccacgatgtagagttccacgaaccgcgggcggcccttgacgtggggcagcttcttgagctcctcgtaggtgagctcgtcggggtcgctgagtccgtgctgctcgagcgcccagtcggcgagatgggggttggcgcggaggaaggaagtccagagatccacggccagggcggtttgcagacggtctcggtactgccggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggggtgaccaccgtcccccgtttcttcttgggcggcggtggtggttcgacttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtgacgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggtttccgcggctaacgagggcgtggctgccccgtcgtttccaagaccccatagccagccgacttctccagttacggagcgagcccctcttttgttttttgtttttgccagatgcatcccgtactgcggcagatgcgcccccaccctccaccgcaacaacagccccctcctccgcagccggcgcttctgcccccgccccagcagcagcaacttccagccacgaccgccgcggccgccgtgagcggggctggacagacttctcagtatgatcacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggatgaaggcgaggatgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcactgctggagcgcgtggcccgctacaacagcaccaacgtgcagaccaacctggaccgcatggttaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctttgaggctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgtcgaggaggagcgcatcctgcgatacgtgcagcaaagcgtgggcctgttcctgatgcaggagggggccacccccagcgccgcgctcgacatgaccgcacgcaacatggagcccagcatgtacgccagcaaccgcccgttcatcaataagctgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggtcgcgagggtgctgccgcggcggtgcccgaggccgccagtccttttcccagcttgcccttctcgctgaacagtatccgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccggtctcagggggccgcgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatgactatgatggtagtcaggatgagctgaagtatgaatgggtggagtttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcccttccaggaaggtttccagatcatgtacgaggatctggaggggggcaacatccccgcgctcctggatgtcgaggcctatgaggacagtaaggaaaaagcagaagccgaggcgactgcagccgtggctaccgccgcaaccaatgcagatgccaatgtgactagaggcgatacattcgccactcaggcggaggaagcagccgccctagcggtcgccgatgatagtgaaagtaagatagtcattcagccggtgaagaaggatagcaagaacagaagctacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcctgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacaccccagccgccgcgcccgtctccaccgtggacgccgtcatcgacagcgtggtggccgacgcgcgccggtacgcccgcgccaagagtcggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagaaagtgatgtggacggactggtggagtttgtgcgcgagttcgccccccggcggcgcgtgcagtggcgcgggcggaaagtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgagcgcggcgccacgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcgacccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccactcgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtagatggcctggcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtaaaactgggtctgcccaccacgcggcccatcgcgcccctggccaccggggtgctgaaacccgaaagtaataagcccgcgaccctggacttgcctcctgcttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggctcccaagggagcacccaattccagccagtgggagcaagcaaagacaggcaataacaatggaaatgggggcactgaatctgttacctttggtgtagccgccatgggcggagggaatattacaaaagagggtcttcaaattggaagtgatgaaactaaaaccgataacaaagaaatttatgcagacaagacctaccaacctgagcctcaaataggagaggagaactggcaagaaacattctctttttatggcggtagagctcttaagaaagatactaagatgaagccatgctatggctcctttgctagacccacaaatgaaaagggaggtcaggccaagtttaaagttcaagacggccagcagactacagactatgacatcgacctggctttctttgatattcccaactctggcacaggaggcaatggtacaaatgttaattatgacccagatatggttatgtatactgaaaatgtgaatctggaaacaccagacacgcatgtggtatacaaacccggaacttcagatgacagttctgaagccaacttgcttcagcagtccatgcctaacagacccaactacattggatttagggacaactttattgggctcatgtattacaacagcactggaaatatgggggtgctggctggtcaggcctcccagctgaatgccgtggtggacttgcaagacagaaacacagagctgtcataccagctcttgcttgactctctgggtgacagaaccaggtatttcagtatgtggaatcaggcggtggacagttatgaccctgatgtgcgcatcattgaaaaccatggtgtggaggatgaattgccaaactattgcttccccttggatggagctggtactaatgctgtataccagggtgttaaagcaaaagataacggaaacgcagccaatggaaattgggaaaaagacacagacgtttcgagtattaaccagatatgcaaggggaacatttatgccatggaaatcaacattcaagccaacctgtggagaagtttcctctactcgaatgtggctctgtacctgcccgattcttacaagtacacgccggccaacattaccctgcccaccaataccaacacctacgattacatgaatgggagagtggtgcctccctcgctggtggacgcctacatcaacatcggggcgcgctggtcgctggaccccatggacaacgtcaatcccttcaaccaccaccgcaatgcggggctgcgctaccgctccatgctcctgggcaacgggcgcttcgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctccgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcgtcgagaaggccaccgccttcgaccgcatggacaatcaagacatgtaacactgtgtgtatgttaaaatatgttttaataaacagcactttaatgttacacatgcatctgagatggtttattatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccagctgacggaacgcctgctgggccttggctccctcggtgaagaagaccccgcaggacttgctagagaactggttggtggcacagccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggcctcggtgcagccgtgcagccacagagcgcacccggtgcactcccagttcttgtgggcgatctgggaatgtgcgtgcacgaagccctgcaggaagcggcccatcatggtcgtcagggtcttgttgctagtgaaggtcagcgggatgccgcggtgctcctcgttgatgtacaggtggcagatgcggcggtacacctcgccctgctcgggcatcagttggaagttggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcatccagggtctcaaagctccgcttgccgtccttctcggtgatccgcaccggggggtagctgaagcccacggccgccagctcctcctcggcctgtctttcgtcctcgctgtcctggctgacgtcctgcatgaccacatgcttggtcttgcggggtttcttcttgggcggcagtggcggcggagatgcttgtggcgagggggagcgcgagttctcgctcaccactactatctcttcctcttcttggtccgatgccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccggcgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccggcaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggccccggcgcccgcctacctgatatcgcctccttggaagaggttccaaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcaccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgctgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcgacctcgtttctgaatctaataccacccacaccggaggtgagctccgaggtcctgattcctcctctgggatttattacggcccctgggaggtggtggggttaatagctttaggcttagtggcgggtgggcttttggctctctgctacctatacctcccttgcttttcctacttagtggtgctttgttgctggtttaagaaatggggaagatcaccctagtgtgcggtgtgctggtggcggtggtgctttcgattctgggagggggaagcgcggctgtagtgacggagaagaaggccgacccctgcttgactttcaaccccgataaatgccagctgagttttcagcctgaaggcaatcggtgcgcagtgttgatcaagtgcggatgggaatgcgagagcgtggcgatccagtataaaaacaagacgcggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggtatgtggcctccacgaaaagaaaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacacctttttcagaccatggcctctgttacaatccttatttattttttgggccttgtgggcactatcagcagtttcgaccataaaaacgtaactgcttatgttggttctaactgtgtactatctgggtaccagtcacatcagcgggtttcatggtactggtttgataaaaagaacacagcttatacactttgcaaaggttatcagcagcccacacatcgcagtggtctttattacagctgcacccataacaatatcacactacttcaagtaaccaaccaatattctgggacctactatggaaccaattttaacacaaaacaggacacttactatagtgtcagtgtattggatccaactactcccagaactacaactaaacataccacaactaaaaagcccactacacctaaaaagcctaccacgcccaaaaccaagacaacaactaagaccactaccacagagccaaccacaaccagcaccacacttgctataactacacacacacacactgagctgacctcacaggcaactactgaaaatggttttgccctgttgcaaaagggggagaatagtagcagtagtcctctgcctactacccccagtgaggaaatacccaagtccatggttggcattatcgctgctgtagtggtgtgtatgctgattatcatcttgtgcatgatgtactatgcctgctactacagaaaacacaggctgaacaacaagctggaccccttactgagtgttgatttttaattttttagaaccatgaagatcctaagcctttttgttttttctataattattacctctgctctatgcaattccgacgatgacgttactgtcgttgttggctccaattacacactgaaaggacctccaaaaggtatgctttcgtggtactgctggtttggaaacgatgagcaacaaacagagctctgcaatcttaaaaatggaaaagtctcaaacccaaaaatctccaattatatttgcaatggaactgatttaatactgctcaatatcacgaaagcatatgctggcagttacacctgccctggagacgacactgagaatatgatttttaaaaaattgattgtagttgaccctactactccagcaccacccaccacaacaactaccaaggcacataccacacacacaaatcaaaccaccccagaggcagaagcagcagagttagcaaagcaggttcaaggagatttctttgttgccaatacacccacaaccggaccgctttgtccagggccattagtcagcggcattgtcggtgtgctttgcgggttagcagttataatcatctgcatgttcatttttgcttgctgctacagaaggcttcaccgacaaaaatcagacccactgctgaacctctatgtttaatttttgatttttccagagccatgaaggcacttagcactttagtatttttgaccttgattggcattgttttcagtaatcctattcctagagttagctttattaagccagttaatgttactgaggggggcaatgtaacactggtaggtgtagagggtgccaaaaacaccacctggacaaaataccaccttaatgggtggaaagacatttgcaattggagtgtgttagtttatacatgtgagggagttaaccttaccattgtcaatgccacctcagctcaaaatggtagaatccaagggcagagtgttagtgtttctgaggggtattatacccagcatacttttatctatgacattaaggtcataccactgccaacacctagcccgcctagcactactcagaccacacaaacaacctacactacacagagctccactaataccatgcagaccactcagacaaccacttacactacatctactgagtccaccaccaccactacagcagaggcgactagctcacctaaaattgaagtggcatttttaatgctggccccatctagcagtcccactgctagtaccaatgagcagactactgaatttttgtccactactcagagcagcaccacagctacctcgagtgccttctctagcaccgccaatctcacctcgctttcctctatgccaatcagtaatgctactacctccccagctcctcttcccactcctctgaagcaatccgagtctagcacgcagctgcagatcaccctgctcattgtgatcggggtggtcatcctggcagtgctgctctacttcatcttctgccgccgcatccccaacgcgaaaccggcctacaagcccattgttatcgggacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcgttgactgggtctttgtgcgcatcgcctacctgcgccaccacccacagtaccgcgaccaaagagtggcgcaagtgttgagactcatctgatgataagcatgcgggctctgctacttctcgcgcttgcactagctcccctcgccgcccccttatccctcaaatcccctacccagtcccctgaagaggttcgaaaatgtaatttccaagaaccctggaaattcctcaaatgctaccagctcaaatcagaaatgcatcccagctggatcatgatcattggaatcgtgaacatccttgcctgtaccctcatctcctttgtgatttacccctgctttaactttgggtggaacgcacccgaggcgctctggctcccgcctgatcccgacacaccaccacagcagcagcaaaatcaggcacatgcaccaccaccacagcctaggccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaattcgagtagttattttccctcctccctcccaactcatggaatacaccaccctctccccacgcacagccttaaacatctgaatgccattggtaatggacatggttttggtctccacattccacacagtttcagagcgagccagtctcgggtcggtcagggagatgaaaccctccgggcactcctgcatctgcacctcaaagttcagtagctgagggctgtcctcggtggtcgggatcacagttatctggaagaagagcgatgagagtcataatccgcgaacgggatcgggcggtggtggcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccaaaacacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcacacgctcatgcatctcttcagcactctcagctcctcgggggtcagaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgatcgtgtcatgatgcagttgctttcggacattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcagaattcgactttcaaattccgtcgaccgttaaaaacgtcacccgccccgcccctaacggtcgccgctctctcggccaatcacagccccacatccccaaattcaaacgcctcatttgcatattaacgcgcacaaaaaagtttgaggtatattattgatgatg

SEQ ID NO: 15 - DNA, 32510 bp, Artificial Sequence
  pBB21.dE1.dE3
catcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacgcgatcgctatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaagatggcatgcgagttggaggagatggtgggcctttggaagatgttgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatttgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcgaaagggttggggcacctcggcccggttgttgatgacctgggcggcgagcacgatctcgtcgaagccgttgatgttgtggcccacgatgtaaagttccacgaatcgcgggcggcccttgacgtggggcagtttcttgagctcctcgtaggtgagctcgtcggggtcgctgagtccgtgctgctcgagcgcccagtcggcgagatgggggttggcgcggaggaaggaagtccaaagatccacggccagggcggtttgcaggcggtcccggtattgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagtggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgcttcggcttccatgtcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccagccgctccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctcctcttcttcttccacctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatatagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgtttttttggccttggtcactggtcatgaaaaactagtaagcgcggaaagcgaccgcccgcgatggctcgctgccgtagtctggagaaagaatcgccagggttgcgttgcggtgtgccccggttcgagcctcggcgctcggcgccggccggattccgcggctaacgtgggcgtggctgccccgtcgtttccaagaccccttagccagccgacttctccagttacggagcgagcccctctttttttcttgtgtttttgccagatgcatcccgtactgcggcagatgcgcccccaccctccaccacaaccgcccctaccgcagcagcagcagcagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcgtcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcatgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaagtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcaaaagatcccaccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccggccgcgagggtgctgccgcggcggttcccgaggccgccagtcctttcccgagcttgcccttctcgctgaacagtattcgcagcagcgagctggggaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccacgagccggggcagcgccgcccgtaaacgccggtggcacgacaggcagcgggggctgatgtgggacgatgaggattccgccgacgacagcagcgtgttggacttgggtgggagtggtggtaacccgttcgctcacctgcgcccccgcatcgggcgcatgatgtaagagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatacgtatgatggtagtcaggatatcttggagtatgaatgggtggagtttgagctacccgaaggcaacttctcggtgaccatgaccatcgacctgatgaacaacgccatcatcgacaattacttggcggtggggcggcagaacggggtcctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtgcgcccgcccgcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcttgcgcgcgcccagcaagatgtacggaggcgctcgccaacgctccacgcaacaccccgtgcgcgtgcgcgggcacttccgcgctccctggggtgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacggactggtggagtttgtgcgcgagttcgcccccaggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaaaatccccacggagcccatggaaacacagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatcaatggccctcacatgccgcctccgcgttcccattacgggctaccgaggaagaaaaccgcgccgtagaaggctggcggggaacgggatgcgtcgccaccaccaccggaggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgaaccgcccccgtacgaggaggcggtgaaactgggtctgcccaccacgcggcccatcgcgcccctggccaccggggtgctgaaacccgaaaagcccgcgaccctggacttgcctccgccttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaattccagccagtgggagcaaaatgaaaacaatggtcaaggtcaagctaagacacacacctatggtgttgctgctatgggcggacttgatattacaaaagagggtcttcaaattggaactgatgctagtaagaaaaatgacaatgaaatttatgccgataaaacatatcagccagagcctcaaataggagaggaaaattggcaagacactgaaaacttttatggaggcagagctcttaaaaaagataccaagatgaagccatgctatggctcatttgccagacctaccaatgtgaagggagggcaagccaaagtgaaaacagaagaaaatgttcagtcattcgacataaatctggctttctttgatattccaagcaccggcacggggggcaatggtacaaatgtagatgataagccagacatggtcatgtacactgaaaatgtgaatctggagacgccagatactcatattgtgtacaaacctggaacttcagatgacagctctgaagccaacttgtgccagcaggccatgccaaacagacctaactacattggtttcagagacaactttattgggctcatgtattacaacagtactggcaatatgggggtgctggctggtcaggcctctcagttgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaaccacggtgtggaagatgaacttcccaactattgcttcccattggatggagctggtactaatgctgtttaccagggtgttaaagaaaaaactggcaataatggcaagtgggaagcagataccaatgttgcctctcagaaccagatatgcaagggtaacatctatgccatggaaatcaacctccaagccaacctgtggagaagttttctctactcgaacgtggccctgtacctgcccgattcttacaagtacacgccggccaacatcaccctgcccactaacaccaatacctatgattacatgaacgggagagtggtgcctccctcgctggtggacgcctacatcaacatcggggcgcgctggtcgttggaccccatggacaacgtcaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccactcatcggcaaaagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgctacttgcatgatgactgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaacaatcaagacatgtaacactgtgtgtatgtttaaaatatctttaataaacagcactttaatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccattccgaagggggtcatcttgcaggtctgccttcccatagtgggcacgcacccgggcttgtggttgcaatcgcagtgcagggggatcagcatcatctgggcctggtcggcgttcattcccgggtacatggccttcatgaacgcctccaattgcctgaacgcctgctgggccttggctccctcggtgaagaagaccccgcaggacttgctagagaactggttggtagcgcacccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggtctcggtgcatccgtgcagccacagcgcgcacccggtgcactcccagttcttgtgggcgatctgggaatgcgcgtgcacgaacccctgcaggaagcggcccatcatggtcgtcagggtcttgttgctagtgaaggtcagcgggatgccgcggtgctcctcgttgatgtacaggtagcagatgcggcggtacacctcgccctgctcgggcatcagctggaagttggctttcaggtcggtctccacgcggtagcggtccatcagcatagtcatgatttccatgcccttctcccaggccgagacgatgggcaggctcatagggttcttcaccatcatcttagcactagcagccgcagccagggggtcgctctcgtccagggtctcaaagctccgcttgccgtccttctcggtgatccgtaccggggggtagctgaagcccacggccgccagctcctcctcggcctgcctttcgtcctcgctgtcctggctgacgtcctgcaggaccacatgcttggtcttgcggggtttcttcttgggcggcagcggcggcggagatgctggagatggcgagggggagcgcgagttctcgctcaccactactatctcttcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagaatgaaagcttaaccgccccgccgcccagccccgcctccgacgcgcccgtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccgacaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgcatccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcggaccgccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaattaaaaacgtcacccgccccgcccctaacggtcgccttcgtcacagccaatcaccttcctccctccccaaattcaaacacctcatttgcatattaacgcgcaccaaaagtttgaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtaatttaaat

SEQ ID NO: 16 - DNA, 32134 bp, Artificial Sequence
  pBB21.dE1.dE3.5IXP
catcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacgcgatcgcggtactgaaatgtgtgggcgtggcttaagggtgggaaagaatatataaggtgggggtcttatgtagttttgtatctgttttgcagcagccgccgccgccatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaagatggcatgcgagttggaggagatggtgggcctttggaagatgttgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatttgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcgaaagggttggggcacctcggcccggttgttgatgacctgggcggcgagcacgatctcgtcgaagccgttgatgttgtggcccacgatgtaaagttccacgaatcgcgggcggcccttgacgtggggcagtttcttgagctcctcgtaggtgagctcgtcggggtcgctgagtccgtgctgctcgagcgcccagtcggcgagatgggggttggcgcggaggaaggaagtccaaagatccacggccagggcggtttgcaggcggtcccggtattgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagtggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgcttcggcttccatgtcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccagccgctccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctcctcttcttcttccacctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatatagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgtttttttggccttggtcactggtcatgaaaaactagtaagcgcggaaagcgaccgcccgcgatggctcgctgccgtagtctggagaaagaatcgccagggttgcgttgcggtgtgccccggttcgagcctcggcgctcggcgccggccggattccgcggctaacgtgggcgtggctgccccgtcgtttccaagaccccttagccagccgacttctccagttacggagcgagcccctctttttttcttgtgtttttgccagatgcatcccgtactgcggcagatgcgcccccaccctccaccacaaccgcccctaccgcagcagcagcagcagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcgtcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcatgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaagtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcaaaagatcccaccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccggccgcgagggtgctgccgcggcggttcccgaggccgccagtcctttcccgagcttgcccttctcgctgaacagtattcgcagcagcgagctggggaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccacgagccggggcagcgccgcccgtaaacgccggtggcacgacaggcagcgggggctgatgtgggacgatgaggattccgccgacgacagcagcgtgttggacttgggtgggagtggtggtaacccgttcgctcacctgcgcccccgcatcgggcgcatgatgtaagagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatacgtatgatggtagtcaggatatcttggagtatgaatgggtggagtttgagctacccgaaggcaacttctcggtgaccatgaccatcgacctgatgaacaacgccatcatcgacaattacttggcggtggggcggcagaacggggtcctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtgcgcccgcccgcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcttgcgcgcgcccagcaagatgtacggaggcgctcgccaacgctccacgcaacaccccgtgcgcgtgcgcgggcacttccgcgctccctggggtgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacggactggtggagtttgtgcgcgagttcgcccccaggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaaaatccccacggagcccatggaaacacagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatcaatggccctcacatgccgcctccgcgttcccattacgggctaccgaggaagaaaaccgcgccgtagaaggctggcggggaacgggatgcgtcgccaccaccaccggaggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgaaccgcccccgtacgaggaggcggtgaaactgggtctgcccaccacgcggcccatcgcgcccctggccaccggggtgctgaaacccgaaaagcccgcgaccctggacttgcctccgccttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaattccagccagtgggagcaaaatgaaaacaatggtcaaggtcaagctaagacacacacctatggtgttgctgctatgggcggacttgatattacaaaagagggtcttcaaattggaactgatgctagtaagaaaaatgacaatgaaatttatgccgataaaacatatcagccagagcctcaaataggagaggaaaattggcaagacactgaaaacttttatggaggcagagctcttaaaaaagataccaagatgaagccatgctatggctcatttgccagacctaccaatgtgaagggagggcaagccaaagtgaaaacagaagaaaatgttcagtcattcgacataaatctggctttctttgatattccaagcaccggcacggggggcaatggtacaaatgtagatgataagccagacatggtcatgtacactgaaaatgtgaatctggagacgccagatactcatattgtgtacaaacctggaacttcagatgacagctctgaagccaacttgtgccagcaggccatgccaaacagacctaactacattggtttcagagacaactttattgggctcatgtattacaacagtactggcaatatgggggtgctggctggtcaggcctctcagttgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaaccacggtgtggaagatgaacttcccaactattgcttcccattggatggagctggtactaatgctgtttaccagggtgttaaagaaaaaactggcaataatggcaagtgggaagcagataccaatgttgcctctcagaaccagatatgcaagggtaacatctatgccatggaaatcaacctccaagccaacctgtggagaagttttctctactcgaacgtggccctgtacctgcccgattcttacaagtacacgccggccaacatcaccctgcccactaacaccaatacctatgattacatgaacgggagagtggtgcctccctcgctggtggacgcctacatcaacatcggggcgcgctggtcgttggaccccatggacaacgtcaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccactcatcggcaaaagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgctacttgcatgatgactgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaacaatcaagacatgtaacactgtgtgtatgtttaaaatatctttaataaacagcactttaatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccattccgaagggggtcatcttgcaggtctgccttcccatagtgggcacgcacccgggcttgtggttgcaatcgcagtgcagggggatcagcatcatctgggcctggtcggcgttcattcccgggtacatggccttcatgaacgcctccaattgcctgaacgcctgctgggccttggctccctcggtgaagaagaccccgcaggacttgctagagaactggttggtagcgcacccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggtctcggtgcatccgtgcagccacagcgcgcacccggtgcactcccagttcttgtgggcgatctgggaatgcgcgtgcacgaacccctgcaggaagcggcccatcatggtcgtcagggtcttgttgctagtgaaggtcagcgggatgccgcggtgctcctcgttgatgtacaggtagcagatgcggcggtacacctcgccctgctcgggcatcagctggaagttggctttcaggtcggtctccacgcggtagcggtccatcagcatagtcatgatttccatgcccttctcccaggccgagacgatgggcaggctcatagggttcttcaccatcatcttagcactagcagccgcagccagggggtcgctctcgtccagggtctcaaagctccgcttgccgtccttctcggtgatccgtaccggggggtagctgaagcccacggccgccagctcctcctcggcctgcctttcgtcctcgctgtcctggctgacgtcctgcaggaccacatgcttggtcttgcggggtttcttcttgggcggcagcggcggcggagatgctggagatggcgagggggagcgcgagttctcgctcaccactactatctcttcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagaatgaaagcttaaccgccccgccgcccagccccgcctccgacgcgcccgtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccgacaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgcatccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcggaccgccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaattaaaaacgtcacccgccccgcccctaacggtcgccttcgtcacagccaatcaccttcctccctccccaaattcaaacacctcatttgcatattaacgcgcaccaaaagtttgaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtaatttaaat

SEQ ID NO: 17 - DNA, 32575 bp, Artificial Sequence
  pBB24.dE1.dE3
catcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgcgatcgccatatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcacttaggttgtcagtttctagaaacgaggaggatttgatattgacggtgccggcggagatgcctttcaagagcccctcgtccatctggtcagaaaagacgatctttttattgtcgagtttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtaggggctgaggggcgtgccccatggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcggctgggcttttcggcacggtagacgatctggcggaagatggcatgcgagttggaggagatggtgggcctttggaagatattgaagtgggcgtggggcaggccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatatagaactggttgacggccttgtaggcacagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaaaccgttgatgttgtggcccacgatgtagagttccacgaaccgcgggcggcccttgacgtggggcagcttcttgagctcctcgtaggtgagctcgtcggggtcgctgagtccgtgctgctcgagcgcccagtcggcgagatgggggttggcgcggaggaaggaagtccagagatccacggccagggcggtttgcagacggtctcggtactgccggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggggtgaccaccgtcccccgtttcttcttgggcggcggtggtggttcgacttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtgacgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggtttccgcggctaacgagggcgtggctgccccgtcgtttccaagaccccatagccagccgacttctccagttacggagcgagcccctcttttgttttttgtttttgccagatgcatcccgtactgcggcagatgcgcccccaccctccaccgcaacaacagccccctcctccgcagccggcgcttctgcccccgccccagcagcagcaacttccagccacgaccgccgcggccgccgtgagcggggctggacagacttctcagtatgatcacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggatgaaggcgaggatgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcactgctggagcgcgtggcccgctacaacagcaccaacgtgcagaccaacctggaccgcatggttaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctttgaggctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgtcgaggaggagcgcatcctgcgatacgtgcagcaaagcgtgggcctgttcctgatgcaggagggggccacccccagcgccgcgctcgacatgaccgcacgcaacatggagcccagcatgtacgccagcaaccgcccgttcatcaataagctgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggtcgcgagggtgctgccgcggcggtgcccgaggccgccagtccttttcccagcttgcccttctcgctgaacagtatccgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccggtctcagggggccgcgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatgactatgatggtagtcaggatgagctgaagtatgaatgggtggagtttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcccttccaggaaggtttccagatcatgtacgaggatctggaggggggcaacatccccgcgctcctggatgtcgaggcctatgaggacagtaaggaaaaagcagaagccgaggcgactgcagccgtggctaccgccgcaaccaatgcagatgccaatgtgactagaggcgatacattcgccactcaggcggaggaagcagccgccctagcggtcgccgatgatagtgaaagtaagatagtcattcagccggtgaagaaggatagcaagaacagaagctacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcctgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacaccccagccgccgcgcccgtctccaccgtggacgccgtcatcgacagcgtggtggccgacgcgcgccggtacgcccgcgccaagagtcggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagaaagtgatgtggacggactggtggagtttgtgcgcgagttcgccccccggcggcgcgtgcagtggcgcgggcggaaagtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgagcgcggcgccacgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcgacccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccactcgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtagatggcctggcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtaaaactgggtctgcccaccacgcggcccatcgcgcccctggccaccggggtgctgaaacccgaaagtaataagcccgcgaccctggacttgcctcctgcttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggctcccaagggagcacccaattccagccagtgggagcaagcaaagacaggcaataacaatggaaatgggggcactgaatctgttacctttggtgtagccgccatgggcggagggaatattacaaaagagggtcttcaaattggaagtgatgaaactaaaaccgataacaaagaaatttatgcagacaagacctaccaacctgagcctcaaataggagaggagaactggcaagaaacattctctttttatggcggtagagctcttaagaaagatactaagatgaagccatgctatggctcctttgctagacccacaaatgaaaagggaggtcaggccaagtttaaagttcaagacggccagcagactacagactatgacatcgacctggctttctttgatattcccaactctggcacaggaggcaatggtacaaatgttaattatgacccagatatggttatgtatactgaaaatgtgaatctggaaacaccagacacgcatgtggtatacaaacccggaacttcagatgacagttctgaagccaacttgcttcagcagtccatgcctaacagacccaactacattggatttagggacaactttattgggctcatgtattacaacagcactggaaatatgggggtgctggctggtcaggcctcccagctgaatgccgtggtggacttgcaagacagaaacacagagctgtcataccagctcttgcttgactctctgggtgacagaaccaggtatttcagtatgtggaatcaggcggtggacagttatgaccctgatgtgcgcatcattgaaaaccatggtgtggaggatgaattgccaaactattgcttccccttggatggagctggtactaatgctgtataccagggtgttaaagcaaaagataacggaaacgcagccaatggaaattgggaaaaagacacagacgtttcgagtattaaccagatatgcaaggggaacatttatgccatggaaatcaacattcaagccaacctgtggagaagtttcctctactcgaatgtggctctgtacctgcccgattcttacaagtacacgccggccaacattaccctgcccaccaataccaacacctacgattacatgaatgggagagtggtgcctccctcgctggtggacgcctacatcaacatcggggcgcgctggtcgctggaccccatggacaacgtcaatcccttcaaccaccaccgcaatgcggggctgcgctaccgctccatgctcctgggcaacgggcgcttcgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctccgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcgtcgagaaggccaccgccttcgaccgcatggacaatcaagacatgtaacactgtgtgtatgttaaaatatgttttaataaacagcactttaatgttacacatgcatctgagatggtttattatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccagctgacggaacgcctgctgggccttggctccctcggtgaagaagaccccgcaggacttgctagagaactggttggtggcacagccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggcctcggtgcagccgtgcagccacagagcgcacccggtgcactcccagttcttgtgggcgatctgggaatgtgcgtgcacgaagccctgcaggaagcggcccatcatggtcgtcagggtcttgttgctagtgaaggtcagcgggatgccgcggtgctcctcgttgatgtacaggtggcagatgcggcggtacacctcgccctgctcgggcatcagttggaagttggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcatccagggtctcaaagctccgcttgccgtccttctcggtgatccgcaccggggggtagctgaagcccacggccgccagctcctcctcggcctgtctttcgtcctcgctgtcctggctgacgtcctgcatgaccacatgcttggtcttgcggggtttcttcttgggcggcagtggcggcggagatgcttgtggcgagggggagcgcgagttctcgctcaccactactatctcttcctcttcttggtccgatgccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccggcgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccggcaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggccccggcgcccgcctacctgatatcgcctccttggaagaggttccaaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcaccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgctgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcggaccgccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgctattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcgactttcaaattccgtcgaccgttaattaaaaacgtcacccgccccgcccctaacggtcgccgctctctcggccaatcacagccccacatccccaaattcaaacgcctcatttgcatattaacgcgcacaaaaaagtttgaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgatttaaat

SEQ ID NO: 18 - DNA, 32198 bp, Artificial Sequence
  pBB24.dE1.dE3.5IXP
catcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgcgatcgcggtactgaaatgtgtgggcgtggcttaagggtgggaaagaatatataaggtgggggtcttatgtagttttgtatctgttttgcagcagccgccgccgccatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcacttaggttgtcagtttctagaaacgaggaggatttgatattgacggtgccggcggagatgcctttcaagagcccctcgtccatctggtcagaaaagacgatctttttattgtcgagtttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtaggggctgaggggcgtgccccatggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcggctgggcttttcggcacggtagacgatctggcggaagatggcatgcgagttggaggagatggtgggcctttggaagatattgaagtgggcgtggggcaggccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatatagaactggttgacggccttgtaggcacagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaaaccgttgatgttgtggcccacgatgtagagttccacgaaccgcgggcggcccttgacgtggggcagcttcttgagctcctcgtaggtgagctcgtcggggtcgctgagtccgtgctgctcgagcgcccagtcggcgagatgggggttggcgcggaggaaggaagtccagagatccacggccagggcggtttgcagacggtctcggtactgccggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggggtgaccaccgtcccccgtttcttcttgggcggcggtggtggttcgacttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtgacgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggtttccgcggctaacgagggcgtggctgccccgtcgtttccaagaccccatagccagccgacttctccagttacggagcgagcccctcttttgttttttgtttttgccagatgcatcccgtactgcggcagatgcgcccccaccctccaccgcaacaacagccccctcctccgcagccggcgcttctgcccccgccccagcagcagcaacttccagccacgaccgccgcggccgccgtgagcggggctggacagacttctcagtatgatcacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggatgaaggcgaggatgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcactgctggagcgcgtggcccgctacaacagcaccaacgtgcagaccaacctggaccgcatggttaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctttgaggctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgtcgaggaggagcgcatcctgcgatacgtgcagcaaagcgtgggcctgttcctgatgcaggagggggccacccccagcgccgcgctcgacatgaccgcacgcaacatggagcccagcatgtacgccagcaaccgcccgttcatcaataagctgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggtcgcgagggtgctgccgcggcggtgcccgaggccgccagtccttttcccagcttgcccttctcgctgaacagtatccgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccggtctcagggggccgcgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatgactatgatggtagtcaggatgagctgaagtatgaatgggtggagtttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcccttccaggaaggtttccagatcatgtacgaggatctggaggggggcaacatccccgcgctcctggatgtcgaggcctatgaggacagtaaggaaaaagcagaagccgaggcgactgcagccgtggctaccgccgcaaccaatgcagatgccaatgtgactagaggcgatacattcgccactcaggcggaggaagcagccgccctagcggtcgccgatgatagtgaaagtaagatagtcattcagccggtgaagaaggatagcaagaacagaagctacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcctgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacaccccagccgccgcgcccgtctccaccgtggacgccgtcatcgacagcgtggtggccgacgcgcgccggtacgcccgcgccaagagtcggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagaaagtgatgtggacggactggtggagtttgtgcgcgagttcgccccccggcggcgcgtgcagtggcgcgggcggaaagtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgagcgcggcgccacgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcgacccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccactcgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtagatggcctggcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtaaaactgggtctgcccaccacgcggcccatcgcgcccctggccaccggggtgctgaaacccgaaagtaataagcccgcgaccctggacttgcctcctgcttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggctcccaagggagcacccaattccagccagtgggagcaagcaaagacaggcaataacaatggaaatgggggcactgaatctgttacctttggtgtagccgccatgggcggagggaatattacaaaagagggtcttcaaattggaagtgatgaaactaaaaccgataacaaagaaatttatgcagacaagacctaccaacctgagcctcaaataggagaggagaactggcaagaaacattctctttttatggcggtagagctcttaagaaagatactaagatgaagccatgctatggctcctttgctagacccacaaatgaaaagggaggtcaggccaagtttaaagttcaagacggccagcagactacagactatgacatcgacctggctttctttgatattcccaactctggcacaggaggcaatggtacaaatgttaattatgacccagatatggttatgtatactgaaaatgtgaatctggaaacaccagacacgcatgtggtatacaaacccggaacttcagatgacagttctgaagccaacttgcttcagcagtccatgcctaacagacccaactacattggatttagggacaactttattgggctcatgtattacaacagcactggaaatatgggggtgctggctggtcaggcctcccagctgaatgccgtggtggacttgcaagacagaaacacagagctgtcataccagctcttgcttgactctctgggtgacagaaccaggtatttcagtatgtggaatcaggcggtggacagttatgaccctgatgtgcgcatcattgaaaaccatggtgtggaggatgaattgccaaactattgcttccccttggatggagctggtactaatgctgtataccagggtgttaaagcaaaagataacggaaacgcagccaatggaaattgggaaaaagacacagacgtttcgagtattaaccagatatgcaaggggaacatttatgccatggaaatcaacattcaagccaacctgtggagaagtttcctctactcgaatgtggctctgtacctgcccgattcttacaagtacacgccggccaacattaccctgcccaccaataccaacacctacgattacatgaatgggagagtggtgcctccctcgctggtggacgcctacatcaacatcggggcgcgctggtcgctggaccccatggacaacgtcaatcccttcaaccaccaccgcaatgcggggctgcgctaccgctccatgctcctgggcaacgggcgcttcgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctccgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcgtcgagaaggccaccgccttcgaccgcatggacaatcaagacatgtaacactgtgtgtatgttaaaatatgttttaataaacagcactttaatgttacacatgcatctgagatggtttattatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccagctgacggaacgcctgctgggccttggctccctcggtgaagaagaccccgcaggacttgctagagaactggttggtggcacagccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggcctcggtgcagccgtgcagccacagagcgcacccggtgcactcccagttcttgtgggcgatctgggaatgtgcgtgcacgaagccctgcaggaagcggcccatcatggtcgtcagggtcttgttgctagtgaaggtcagcgggatgccgcggtgctcctcgttgatgtacaggtggcagatgcggcggtacacctcgccctgctcgggcatcagttggaagttggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcatccagggtctcaaagctccgcttgccgtccttctcggtgatccgcaccggggggtagctgaagcccacggccgccagctcctcctcggcctgtctttcgtcctcgctgtcctggctgacgtcctgcatgaccacatgcttggtcttgcggggtttcttcttgggcggcagtggcggcggagatgcttgtggcgagggggagcgcgagttctcgctcaccactactatctcttcctcttcttggtccgatgccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccggcgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccggcaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggccccggcgcccgcctacctgatatcgcctccttggaagaggttccaaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcaccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgctgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcggaccgccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgctattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcgactttcaaattccgtcgaccgttaattaaaaacgtcacccgccccgcccctaacggtcgccgctctctcggccaatcacagccccacatccccaaattcaaacgcctcatttgcatattaacgcgcacaaaaaagtttgaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaaggaattgatttaaat

SEQ ID NO: 19 - DNA, 35990 bp, Artificial Sequence
  HAdV4
ctatctatataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtaggtgtcagctgatcgtcagggtatttaaacctgcgctctgcagtcaagaggccactcttgagtgccagcgagaagagttttctcctccgcgccgcgagtcagatctacactttgaaatatgaggcacctaagagacctgcccgatgaggaaattatcatcgcttccgggagcgagattctggaactggtggtaaatgctatgatgggcgacgaccatccggaaccccccaccccatttgagacaccttcgctgcacgatttgtatgatctggaggtggatgtgcccgaggacgaccccaacgagaaggcggtaaatgatttatttagcgatgccgcgctgctagctgccgaggaggcttcaagccctagctcagacagcgactcttcactgcatacccctagacacgacagaggtgagaaagagatccccgggcttaaatgggaaaagatggacttgcgttgctatgaggaatgcctgcccccaagcgatgatgaggacgagcaggcgattcagaacgcagcgagccatggagtgcaagccgtcagcgagagctttgcactggactgcccgcctttgcccggacacggctgtaagtcttgtgaatttcatcgcatcaatactggagataaagctgtgttatgtgcactttgctatatgagagcgtacaaccattgtgtttacagtaagtgtgattaagtgaactttaaagggaggcaaagagtagggtgactgggtgatgactggtttatttatgtatatctgttttttatataggtcccgtttctgacgcagatgatgagacccccactacagagtccactttgtcaccccctgaaattggcacgtctccatctgacaatattgttagaccagttcctgtaagagccactgggaggagagcagctgtagaatgtttggatgatttgcttcagggtggagatgaacctttggacttgtgtacccggaaacgccccaggcattaagtgccacacatgtgtgtttacttgaggtgatgtcagtatttatagggtgtggagtgcaataaaatatgtgttgactttaagtgcgtggtttatgactcaggggaggggactttgggtatataagcaggtgcagacctgtgtggttagctcagagcggtatggagatttggacggttttggaagactttcacaagactaggcagctgctagagaacgcctcgaacggagtctcttacctgtggagattctgcttcggcggtgacctagctaagctagtctatagggccaaacaggattatagggaacaatttgaggatattttgagagagtgtcctggtctttttgacgctcttaacttgggccatcagtctcactttaaccagagaatttcaagagcccttgactttactactcctggcagaaccactgcagcagtagccttttttgcttttatttttgacaaatggagtcaagaaacccatttcagcagggattaccagctggatttcttagcagtagctttgtggagaacatggaagtgccagcgcctgaatgcaatctccggctacttgccggtacagccgctagacactctgaggatcctgagtctccagcagcaggaggatcaagaagagaatccgagagccggcctggaccctccggcggaggagtagctgacctgtttcctgaactgcaccgggtgctgactaggtcttcgagtggtcgggagaggggtattaagcgggagaggcatgatgagactaatcacagaattgaactgactgtgggtctgatgagccgcaagcgtccagaaacagtgtggtggtatgaggtgcagtcaactggcacagatgaggtgtcagtcatgcatgagagattttccctagaacaagtcaagacttgttggttggagcctgaggatgattgggaggtagccatcaggaattatgccaagctggctctgaggccagatagaaagtacaagattactaagctgataaatatcagaaatgcctgctacatctcagggaatggggctgaagtggagatctgtctccaggatagagtggctttcagatgctgcatgatgaatatgtacccgggagtggtggacatggatggggtcacctttatgaacatgaggttcaggggagatgggtataatgggacggtctttatggccaataccaagctgacagtgcatggatgctccttctttgggtttaataacacctgcatcgaggcttggggtcaggtcggtgttaaggggtgcagtttttcagccaactggatgggggtagtgggcaggaccaagagtatgctgtctgtgaagaaatgcttgtttgagaggtgccacctgggggtgatgagcgagggcgaagccagaatccgccactgtgcctctaccgagacgggctgttttgtgctgtgcaagggcaatgccaagatcaagcataatatgatctgtggagcctcggacgagcgcggctaccagatgctgacctgcgccggtgggaacagtcatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcctacccacgatgtgaccaccgaccgcagccagcggctgacgctgcgctttgtgcccgtggaccgggaggacaacacctactcgtacaaagtgcgctacacgctggccgtgggcgacaaccgcgtgctggacatggccagcacctactttgacatccgcggcgtgctggatcggggccctagcttcaaaccctactccggcactgcctacaacagcctggctcccaagggagcgcccaacacctgccagtggaaggattctgacagcaaaatgcatacctttggggcagctgccatgcccggtgttactgggaaaaagatagaagctgatgggctgcctattagaatagattcaacttctggaactgacacagtaatttatgctgataaaactttccaaccagaaccacaagttggaaatgacagttgggttgacaccaatggtgcagaggaaaaatatggaggcagagctctaaaggacactacaaaaatgaaaccctgttatggttcattcgccaagcctaccaacaaagaaggtggtcaggctaacttaaaagattcagaacccgccgccaccactcctaactatgatatagacctggctttctttgacagcaaaactattgttgctaactacgatccagatattgtaatgtacacagaaaatgttgacttgcagactccagatactcatattgtatacaaacctggaacagaggacaccagctctgaatccaatttgggtcagcaggccatgcctaacagacccaactacattggcttcagagacaattttatcgggctcatgtactacaacagcactggcaatatgggggtgctggccggtcaggcctctcagctgaatgctgtggttgacttgcaagacagaaacactgaactgtcctaccagctcttgcttgactctctgggtgacagaacccggtatttcagtatgtggaatcaggcggtggacagctatgatcctgatgtgcgcattattgaaaaccatggtgtggaggatgaattgccaaactattgctttccgttgaatggtgtgggattgacagacacttaccagggtgttaaagttaaaacagatgcaggttctgaaaagtgggacaaagatgacaccacagttagtaatgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaacggccgggtggtggcgccctcgctggtggacgcctacattaacattggggcgcgctggtcgctggaccccatggacaacgtaaatcccttcaaccaccaccgcaatgcgggcttgcgctaccgctccatgctcctgggcaacgggcgctacgtgccattccacatccaggtgccccagaaattttttgccattaagagcctcctgctcctgcccgggtcctacacctacgagtggaacttccgcaaggacgtcaacatgatcctgcagagttcccttggcaacgacctgcgcacagacggggcctccatcaccttcaccagcattaacctctacgccaccttcttccccatggcgcacaacaccgcctccacgcttgaggccatgctgcgcaacgacaccaatgaccaatccttcaacgactacctctcggcggccaacatgctctatcccatcccggccaacgccaccaacgtgcccatctccatcccctcgcgcaactgggccgcctttcgcggctggtccttcacgcgactcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctcgttgaatctaataccacccacaccggaggtgagctccgaggtcctcagtcatctgggatttattacggtccctgggaggtggtggggttaatagctttaggcttagtagcgggtgggcttttggctctttgctacctatacctcccttgcttttcctacttagtggtgctttgttgctggtttaagaaatggggaagatcaccctagtgtgcggtgtgctggtggcggtactttcgattttgggtctgggcagcgcggctgtagtgacggagaaggccgatccctgcttgacttttaaccccgacaaatgccagctgagttttcagccagatggcaatcggtgcgcggtgttgattaagtgcggatgggaatgccagagcgtggcgatccagtataaaaacaagacgcggaacaatactctcgcgtccacatggcagcccggggaccccgagtggtacaccgtctctgtccctggtgctgacggcttccttcgcacggtaaacaacacttttatttttgagcacatgtgcaataccgccatgttcatgagcaggcagtaccatatgtggcccccacggaaagagaatatcgtggtcttctccatcgcttacagcttgtgcacggtgctaatcaccgcgatcgtgtgcctgagcattcacatgctcatcgctattcgccccagaaataatgctgagaaagagaaacagccataacaccattttttcacacacctttttcagaccatggcctctgttacagccattatttattttttgggtcttctgggatttatcaacagttttgaccataaaaacgtaactgcttatgttggttctaactgtgtactaactgggtaccagtcacaccaacgggtttcatggtactggtttgataaaaaaaacacagcttatacactttgcaaaggtaatcagcggcccacacagcgcagtggtctttattacagctgcactaataataatatcacactacttcaagtgactaaacaatattctgggacatactatggaaccaattttaacacggaacaggacacttactatagtgtcaaagtattggatccaactactcccagaactactaccaaacataccacaactaaaaagcccactatacctaaaaccactaaattaacaaccacaaccagcaccacacttgctgtgacctcacaggcaactactgaaaacgaattggttgccctgttgcagaatggggagaataatagcagcagtcctctgcctaccacccccagtgagcaaattcccagatccatgattggcattatcgctgctgtggtggtgtgtatggtcattatcatcttgtgcatgatgtactatgcctgctactacagaaaacacagactgaacaacaagctggacccctactgaattttgatttttaattacaaattaattgtggttgatcccactacacctccacccaccacaactaccacagacacacaagaacccactccagaggcagtagcagagttagcaaagcagatttatgaagattcctttgttgctaatactcccacacacctcggaccgcaatgtccagggttagtagtcagcggcatcgtcggtgtgctttgtgggttagcagttataatcatctgcatgttcatttttgcttgctgctacagaaggcttcaccgacagaaatcagacccactgctgaacctctatgtttaatttttgattttccagagccatgaaggcacttagcactttagtttttttgtccttgattggcattgtttttagtaatcctattcctagagttagctttattaaaccagttaatgttactgaagggagcaatgtgacactggtaggtgtagagggtgctaaaaacaccacctggacaaaatatcaccttaatgggtggaaagatatctgcaattggagtgtgacagtttatacatgcgagggagttaatcttaccattgtcaatgcaacctcagctcaaaatggtagaattcaagggcaaagtgttagtgattctgaggggtattatacccaacatacttttatctatgacattaaggtcataccattgccaacacccagcccacctagcactactcaaaccactacatcaactcagcccaccgccaccacaacagcagaggcatttttgttgctgccaccatctagcagtcccactgctagtaccaataagcagactactaaatttttgtccactactgaaagccacaccacagctaccttgagagccttctctagcaccgctaatcttacctcgctttcctatacattaatcagttctgttactacctctaccccagcttctcttcccactcccctgaagcaaaccgaaggcggtttgcaatggcagatcaccctactcattgtgatcggggtggtcatcctagcgatgctgctctacttcatcttctgccgccgcatccccaacgcgaaaccggtctacaagcccatcgttatcgggcagccggagccgcttcaggtggagggaggtctaaggaatcttctcttctcttttacagtatggtgatttgaactatgattcctagacagttctttatcattggtcttctctgcgcgctccaagtctgtgccaccctcgctctggtggctaatgcgagtccagactgcattggaccgttcgcctcctacgtgctctttgccttcatcacctgcatctgctgctgtagcatagtctgcctgcttattaccttcttccagttcgttgactgggtctttgtgcgcatcgcctacctgcgccaccacccccagtaccgcgaccaaagagtggcgcagctgctcaggctcatctgataagcatgcgggctttgctacttctcatgcttctactattgctagctcccctggtcgccccctttcccctcaaatcccccacccagtcccccaaagaggttcgaaactgtaaattccaagaaccctggaaattcctcaaatgctaccagctcaaatcagacatgcaccccagctggataattatcatgggaatcgtgaacatccttgcctgcaccttcttttcctttgtgatttacccccgctttgactttggttggaacgcacccgaggcgctctggctcccgcctgatcccgacacaccaccacagcagcagcaaaatcaggcacacgcaccaccaccacagcctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtatccctacgatgcagacaacgcaccgaccgtgcccttcatcaaccctcccttcgtctcttcagatggattccaagaaaagcccctgggggtgttgtcccttaggctggccgaccctgtcaccaccaagaatggggaaattaccctcaagctgggggagggggtggaccttgacgactcgggaaaactcattgcaaacacagtaaacaaggccattgcccctctcagtttttccaacaacaccatttcccttaacatggatacccctttatacaccaaagatggaaaactatccttacaagtttctccaccattaagtatattaaaatcaacaattttgaatacattagctctagcttttggctcaggtttaggactcagtggcagcgccctggcagtacagttagcctctccacttacatttgatgataaagggaatataaagattaccctaaacaggggattgcatgttacaacaggagatgcaattgaaagcaacatcagttgggctaaaggtataaaatttgaagatggtgccatagctacaaacattggtaaggggctagagttcggaaccagtagtacagaaacaggagttaataatgcttatccaatccaagttaaacttggctctggtctcagctttgacagcacaggagccataatggctggcaataaagactatgataaattaactttgtggacaacgcctgacccatcaccaaactgtcaaatacttgcagaaaatgatgcaaaactaacactttgcttaactaagtgtgacagtcaaatactggccactgtatcagttttggttgttagaagtggaaacttaaacccaattactggcacagtaagcagtgctcaagtttttctacgttttgatgcaaatggtgttcttttaacagaacactctacactaaaaaaatactggggctacaagcaaggagatagcatagatggcactccatacaccaatgctgttggttttatgccaaattcaacagcttatccaaagacccaaagttctactactaaaaataatatagtgggtcaagtatacatgaatggagatgtttcaaaacccatgcttcttactataactcttaatggtactgatgacaccaccagtgcatactcaatgtcattttcatacacctggactaacggaagctatatcggagcaacatttggagctaactcatacaccttctcctacatagcccaacaataatcccaccctgcatgccaacccaccttttccctctatttataaatggaaactgaaacaaaaataaagttcaagtgttttattgattcaacagtttttcacaggattcgagtagttattttccctccaccctcccatctcatggaatacactatcctctccccacgcacagccttaaacatctgaatgctattggtaatggacatggttttgatctccacattccacacagtttcagagcgagacagtctcgggtcggtcaaggagatgaaaccctccgggcactcctgcatctgcacctcacagttcaacagctgagggctgtcctcggtgattggaatcacagttatctggaataagagcgatgagaatcataatccgcaaacgggatcgggcggttgtggcgcatcaggccccgcagcagtcgctgtctgcgccgctccgtcaagctgctactcaaggggtccgggtccagggactccctgcgcatgatgccaatggccctgagcatcagtcgcctggtacggcgggcgcagcagcggatgcggatctcactcaggtcggagcagtacgtgcagcacagcaccaccaagttgttcaacagtccatagttcaacgtgctccagccaaaactcatttgtggaactatgctgcccacatgtccatcgtaccagatcctgatgtaaatcaggtggcgtcccctccagaacacactgcccatgtacatgatctccttgggcatgtgcaggttcaccacctcccggtaccacatcacccgctggttgaacatgcagccctggataattctgcggaaccagatggcaagtaccgtcccgcccgccatgcagcgcagggaccccgggttctggcaatggcagtggatcacccaccgctcgcgaccgtggatcaactgggaactaaacaagtctatgttggcacagcacaggcacacgctcatgcatgtcttcagcactctcaattcctcgggggtcaggaccatatcccagggcacagggaactcttgcaggacagtgaacccggccgaacagggcaatcctcgcacggaacttacattgtgcatggacagggtatcgcaatcaggcagcaccggatgatcctccaccagagaagcgcggctctcggtctcctcacagcgaggtaaggtggccggcggttggtacggatgatggcgagataacgctaatcgtgttctggatcgtgtcatgatggagctgtttccggacattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaaacacatcagttaccccgcccctaacgaacgccgctgtcacagccaatcagcgcgccccatccccaaattttcacgccttatttgcatattaactcacacaaaaaaaataaggtatattatatagatag

SEQ ID NO: 20 - DNA, 32409 bp, Artificial Sequence
  pAd4.5orf6
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcctacccacgatgtgaccaccgaccgcagccagcggctgacgctgcgctttgtgcccgtggaccgggaggacaacacctactcgtacaaagtgcgctacacgctggccgtgggcgacaaccgcgtgctggacatggccagcacctactttgacatccgcggcgtgctggatcggggccctagcttcaaaccctactccggcactgcctacaacagcctggctcccaagggagcgcccaacacctgccagtggaaggattctgacagcaaaatgcatacctttggggcagctgccatgcccggtgttactgggaaaaagatagaagctgatgggctgcctattagaatagattcaacttctggaactgacacagtaatttatgctgataaaactttccaaccagaaccacaagttggaaatgacagttgggttgacaccaatggtgcagaggaaaaatatggaggcagagctctaaaggacactacaaaaatgaaaccctgttatggttcattcgccaagcctaccaacaaagaaggtggtcaggctaacttaaaagattcagaacccgccgccaccactcctaactatgatatagacctggctttctttgacagcaaaactattgttgctaactacgatccagatattgtaatgtacacagaaaatgttgacttgcagactccagatactcatattgtatacaaacctggaacagaggacaccagctctgaatccaatttgggtcagcaggccatgcctaacagacccaactacattggcttcagagacaattttatcgggctcatgtactacaacagcactggcaatatgggggtgctggccggtcaggcctctcagctgaatgctgtggttgacttgcaagacagaaacactgaactgtcctaccagctcttgcttgactctctgggtgacagaacccggtatttcagtatgtggaatcaggcggtggacagctatgatcctgatgtgcgcattattgaaaaccatggtgtggaggatgaattgccaaactattgctttccgttgaatggtgtgggattgacagacacttaccagggtgttaaagttaaaacagatgcaggttctgaaaagtgggacaaagatgacaccacagttagtaatgctaatgaaatccatgtaggcaatccttttgccatggaaatcaacatccaagccaacctgtggaggaacttcctctatgccaatgttgccctctatttgcctgataaatacaaatacacaccggccaacatcaccctgcccaccaacaccaacacctacgagtacatgaacggccgggtggtggcgccctcgctggtggacgcctacattaacattggggcgcgctggtcgctggaccccatggacaacgtaaatcccttcaaccaccaccgcaatgcgggcttgcgctaccgctccatgctcctgggcaacgggcgctacgtgccattccacatccaggtgccccagaaattttttgccattaagagcctcctgctcctgcccgggtcctacacctacgagtggaacttccgcaaggacgtcaacatgatcctgcagagttcccttggcaacgacctgcgcacagacggggcctccatcaccttcaccagcattaacctctacgccaccttcttccccatggcgcacaacaccgcctccacgcttgaggccatgctgcgcaacgacaccaatgaccaatccttcaacgactacctctcggcggccaacatgctctatcccatcccggccaacgccaccaacgtgcccatctccatcccctcgcgcaactgggccgcctttcgcggctggtccttcacgcgactcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtatccctacgatgcagacaacgcaccgaccgtgcccttcatcaaccctcccttcgtctcttcagatggattccaagaaaagcccctgggggtgttgtcccttaggctggccgaccctgtcaccaccaagaatggggaaattaccctcaagctgggggagggggtggaccttgacgactcgggaaaactcattgcaaacacagtaaacaaggccattgcccctctcagtttttccaacaacaccatttcccttaacatggatacccctttatacaccaaagatggaaaactatccttacaagtttctccaccattaagtatattaaaatcaacaattttgaatacattagctctagcttttggctcaggtttaggactcagtggcagcgccctggcagtacagttagcctctccacttacatttgatgataaagggaatataaagattaccctaaacaggggattgcatgttacaacaggagatgcaattgaaagcaacatcagttgggctaaaggtataaaatttgaagatggtgccatagctacaaacattggtaaggggctagagttcggaaccagtagtacagaaacaggagttaataatgcttatccaatccaagttaaacttggctctggtctcagctttgacagcacaggagccataatggctggcaataaagactatgataaattaactttgtggacaacgcctgacccatcaccaaactgtcaaatacttgcagaaaatgatgcaaaactaacactttgcttaactaagtgtgacagtcaaatactggccactgtatcagttttggttgttagaagtggaaacttaaacccaattactggcacagtaagcagtgctcaagtttttctacgttttgatgcaaatggtgttcttttaacagaacactctacactaaaaaaatactggggctacaagcaaggagatagcatagatggcactccatacaccaatgctgttggttttatgccaaattcaacagcttatccaaagacccaaagttctactactaaaaataatatagtgggtcaagtatacatgaatggagatgtttcaaaacccatgcttcttactataactcttaatggtactgatgacaccaccagtgcatactcaatgtcattttcatacacctggactaacggaagctatatcggagcaacatttggagctaactcatacaccttctcctacatagcccaacaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattcatttaaat

SEQ ID NO: 21 - DNA, 35118 bp, Artificial Sequence
  pAd4.Ptr01.BB24.5orf6.FLuc
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaatgctctggctcctaaagctgctcctaatccaagtcaatgggaagaaacttccacagatgctactactactactactcacagctttggcctggctgctatgaagggggacaatattacatctgacggtttgcagataggaacagatgctacttctggagaggaaaaacccatctatgcagataaactgtaccagccagaaccccaaataggggaagagtcatggactgatactgacggaaccaatgaaaaattcggaggaagagtccttaaaaaggacacaagcatgaaaccctgctacgggtcatttgccaagccaaccaataacaaaggtgggcaggcaaaacaaaaggcaacggaaggaaccactgtagaatatgatgttgacatgaacttttttgatggtagagatgcagctgctaactttactccagaagtagtgttgtatgctgaaaatgttgatttggaaactccagatacacatattgtatacaagccaggaacctcagatgtgagttcccatgtcaatttgggtcagcaagccatgcccaacagacccaactacattgggttcagggacaactttattgggctgatgtactacaacagcactggcaatatgggtgtgctggccggtcaggcctctcagctgaatgctgtggttgacttgcaagacagaaacaccgaactgtcttaccagctcttgcttgactctctgggtgacagaacccggtacttcagtatgtggaatcaggcggtggacagttatgatcctgatgtgcgcattattgaaaatcatggtatagaagatgagcttcccaactattgcttccccattgacgctgtgggtattactaaaacttatcaaggtatcaaaacgcaaaatggtcaaactacaacgtgggaaaaggacaccagtgttagtacggccaatgaaataggcattggcaacaatcttgctatggaaatcaacatccaagccaacctctggaggaacttcctctatgccaacgtggccctgtacctgcccgactcttacaagtacacgccggccaacgtcactctgcccaccaacaccaatacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattcatttaaat

SEQ ID NO: 22 - DNA, 35142 bp, Artificial Sequence
  pAd4.Ptr13.BB21.5orf6.FLuc
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagcacccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccaccaatgaaaagggaggacaggctaaacttaaagttggagatgatggagttccaaccaaagaatttgacatagacctggctttctttgatactcccggtggcactgtgaatggccaagatgagtataaagcagacattgtcatgtataccgaaaacgcctatctggaaactccagacacacatgtggtatacaaaccaggcaaggaagatgcaagttctgaaattaacctggttcagcagtccatgcccaacagacccaactacattgggttcagggacaactttattggtctcatgtattacaacagcactggcaatatgggggtgctggccggtcaggcctcacagctgaatgctgtggttgacttgcaagacagaaacactgagctgtcctaccagctcttgcttgactctctgggtgacagaacccggtatttcagtatgtggaatcaggcggtggacagttatgatcctgatgtgcgcattattgaaaaccatggtgtggaggatgaactgccaaactattgcttccccttggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggaaatcaacctccaagccaacctgtggaggagtttcctctactcgaacgtggccctgtacctgcccgactcttacaagtacacgccggccaacgtcaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaagcccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattcatttaaat

SEQ ID NO: 23 - DNA, 32448 bp, Artificial Sequence
  pAd4.Ptr01.BB24.5orf6
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaatgctctggctcctaaagctgctcctaatccaagtcaatgggaagaaacttccacagatgctactactactactactcacagctttggcctggctgctatgaagggggacaatattacatctgacggtttgcagataggaacagatgctacttctggagaggaaaaacccatctatgcagataaactgtaccagccagaaccccaaataggggaagagtcatggactgatactgacggaaccaatgaaaaattcggaggaagagtccttaaaaaggacacaagcatgaaaccctgctacgggtcatttgccaagccaaccaataacaaaggtgggcaggcaaaacaaaaggcaacggaaggaaccactgtagaatatgatgttgacatgaacttttttgatggtagagatgcagctgctaactttactccagaagtagtgttgtatgctgaaaatgttgatttggaaactccagatacacatattgtatacaagccaggaacctcagatgtgagttcccatgtcaatttgggtcagcaagccatgcccaacagacccaactacattgggttcagggacaactttattgggctgatgtactacaacagcactggcaatatgggtgtgctggccggtcaggcctctcagctgaatgctgtggttgacttgcaagacagaaacaccgaactgtcttaccagctcttgcttgactctctgggtgacagaacccggtacttcagtatgtggaatcaggcggtggacagttatgatcctgatgtgcgcattattgaaaatcatggtatagaagatgagcttcccaactattgcttccccattgacgctgtgggtattactaaaacttatcaaggtatcaaaacgcaaaatggtcaaactacaacgtgggaaaaggacaccagtgttagtacggccaatgaaataggcattggcaacaatcttgctatggaaatcaacatccaagccaacctctggaggaacttcctctatgccaacgtggccctgtacctgcccgactcttacaagtacacgccggccaacgtcactctgcccaccaacaccaatacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattcatttaaat

SEQ ID NO: 24 - DNA, 32472 bp, Artificial Sequence
  pAd4.Ptr13.BB21.5orf6
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagcacccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccaccaatgaaaagggaggacaggctaaacttaaagttggagatgatggagttccaaccaaagaatttgacatagacctggctttctttgatactcccggtggcactgtgaatggccaagatgagtataaagcagacattgtcatgtataccgaaaacgcctatctggaaactccagacacacatgtggtatacaaaccaggcaaggaagatgcaagttctgaaattaacctggttcagcagtccatgcccaacagacccaactacattgggttcagggacaactttattggtctcatgtattacaacagcactggcaatatgggggtgctggccggtcaggcctcacagctgaatgctgtggttgacttgcaagacagaaacactgagctgtcctaccagctcttgcttgactctctgggtgacagaacccggtatttcagtatgtggaatcaggcggtggacagttatgatcctgatgtgcgcattattgaaaaccatggtgtggaggatgaactgccaaactattgcttccccttggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggaaatcaacctccaagccaacctgtggaggagtttcctctactcgaacgtggccctgtacctgcccgactcttacaagtacacgccggccaacgtcaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaagcccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattcatttaaat

SEQ ID NO: 25 - DNA, 1323 bp, Artificial Sequence
  BB24 fiber
atgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataa

SEQ ID NO: 26 - DNA, 1323 bp, Artificial Sequence
  BB21 fiber
atgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaagcccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataa

SEQ ID NO: 27 - DNA, 99 bp, Artificial Sequence
  HAdV-5 protein IX promoter
ggtactgaaatgtgtgggcgtggcttaagggtgggaaagaatatataaggtgggggtcttatgtagttttgtatctgttttgcagcagccgccgccgcc

SEQ ID NO: 28 - DNA, 30499 bp, Artificial Sequence
  BB21.dE1.dE3 Ad vector genome
catcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacgcgatcgctatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaagatggcatgcgagttggaggagatggtgggcctttggaagatgttgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatttgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcgaaagggttggggcacctcggcccggttgttgatgacctgggcggcgagcacgatctcgtcgaagccgttgatgttgtggcccacgatgtaaagttccacgaatcgcgggcggcccttgacgtggggcagtttcttgagctcctcgtaggtgagctcgtcggggtcgctgagtccgtgctgctcgagcgcccagtcggcgagatgggggttggcgcggaggaaggaagtccaaagatccacggccagggcggtttgcaggcggtcccggtattgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagtggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgcttcggcttccatgtcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccagccgctccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctcctcttcttcttccacctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatatagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgtttttttggccttggtcactggtcatgaaaaactagtaagcgcggaaagcgaccgcccgcgatggctcgctgccgtagtctggagaaagaatcgccagggttgcgttgcggtgtgccccggttcgagcctcggcgctcggcgccggccggattccgcggctaacgtgggcgtggctgccccgtcgtttccaagaccccttagccagccgacttctccagttacggagcgagcccctctttttttcttgtgtttttgccagatgcatcccgtactgcggcagatgcgcccccaccctccaccacaaccgcccctaccgcagcagcagcagcagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcgtcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcatgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaagtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcaaaagatcccaccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccggccgcgagggtgctgccgcggcggttcccgaggccgccagtcctttcccgagcttgcccttctcgctgaacagtattcgcagcagcgagctggggaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccacgagccggggcagcgccgcccgtaaacgccggtggcacgacaggcagcgggggctgatgtgggacgatgaggattccgccgacgacagcagcgtgttggacttgggtgggagtggtggtaacccgttcgctcacctgcgcccccgcatcgggcgcatgatgtaagagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatacgtatgatggtagtcaggatatcttggagtatgaatgggtggagtttgagctacccgaaggcaacttctcggtgaccatgaccatcgacctgatgaacaacgccatcatcgacaattacttggcggtggggcggcagaacggggtcctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtgcgcccgcccgcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcttgcgcgcgcccagcaagatgtacggaggcgctcgccaacgctccacgcaacaccccgtgcgcgtgcgcgggcacttccgcgctccctggggtgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacggactggtggagtttgtgcgcgagttcgcccccaggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaaaatccccacggagcccatggaaacacagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatcaatggccctcacatgccgcctccgcgttcccattacgggctaccgaggaagaaaaccgcgccgtagaaggctggcggggaacgggatgcgtcgccaccaccaccggaggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgaaccgcccccgtacgaggaggcggtgaaactgggtctgcccaccacgcggcccatcgcgcccctggccaccggggtgctgaaacccgaaaagcccgcgaccctggacttgcctccgccttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaattccagccagtgggagcaaaatgaaaacaatggtcaaggtcaagctaagacacacacctatggtgttgctgctatgggcggacttgatattacaaaagagggtcttcaaattggaactgatgctagtaagaaaaatgacaatgaaatttatgccgataaaacatatcagccagagcctcaaataggagaggaaaattggcaagacactgaaaacttttatggaggcagagctcttaaaaaagataccaagatgaagccatgctatggctcatttgccagacctaccaatgtgaagggagggcaagccaaagtgaaaacagaagaaaatgttcagtcattcgacataaatctggctttctttgatattccaagcaccggcacggggggcaatggtacaaatgtagatgataagccagacatggtcatgtacactgaaaatgtgaatctggagacgccagatactcatattgtgtacaaacctggaacttcagatgacagctctgaagccaacttgtgccagcaggccatgccaaacagacctaactacattggtttcagagacaactttattgggctcatgtattacaacagtactggcaatatgggggtgctggctggtcaggcctctcagttgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaaccacggtgtggaagatgaacttcccaactattgcttcccattggatggagctggtactaatgctgtttaccagggtgttaaagaaaaaactggcaataatggcaagtgggaagcagataccaatgttgcctctcagaaccagatatgcaagggtaacatctatgccatggaaatcaacctccaagccaacctgtggagaagttttctctactcgaacgtggccctgtacctgcccgattcttacaagtacacgccggccaacatcaccctgcccactaacaccaatacctatgattacatgaacgggagagtggtgcctccctcgctggtggacgcctacatcaacatcggggcgcgctggtcgttggaccccatggacaacgtcaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccactcatcggcaaaagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgctacttgcatgatgactgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaacaatcaagacatgtaacactgtgtgtatgtttaaaatatctttaataaacagcactttaatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccattccgaagggggtcatcttgcaggtctgccttcccatagtgggcacgcacccgggcttgtggttgcaatcgcagtgcagggggatcagcatcatctgggcctggtcggcgttcattcccgggtacatggccttcatgaacgcctccaattgcctgaacgcctgctgggccttggctccctcggtgaagaagaccccgcaggacttgctagagaactggttggtagcgcacccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggtctcggtgcatccgtgcagccacagcgcgcacccggtgcactcccagttcttgtgggcgatctgggaatgcgcgtgcacgaacccctgcaggaagcggcccatcatggtcgtcagggtcttgttgctagtgaaggtcagcgggatgccgcggtgctcctcgttgatgtacaggtagcagatgcggcggtacacctcgccctgctcgggcatcagctggaagttggctttcaggtcggtctccacgcggtagcggtccatcagcatagtcatgatttccatgcccttctcccaggccgagacgatgggcaggctcatagggttcttcaccatcatcttagcactagcagccgcagccagggggtcgctctcgtccagggtctcaaagctccgcttgccgtccttctcggtgatccgtaccggggggtagctgaagcccacggccgccagctcctcctcggcctgcctttcgtcctcgctgtcctggctgacgtcctgcaggaccacatgcttggtcttgcggggtttcttcttgggcggcagcggcggcggagatgctggagatggcgagggggagcgcgagttctcgctcaccactactatctcttcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagaatgaaagcttaaccgccccgccgcccagccccgcctccgacgcgcccgtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccgacaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgcatccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcggaccgccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaattaaaaacgtcacccgccccgcccctaacggtcgccttcgtcacagccaatcaccttcctccctccccaaattcaaacacctcatttgcatattaacgcgcaccaaaagtttgaggtatattattgatgatg

SEQ ID NO: 29 - DNA, 30123 bp, Artificial Sequence
  BB21.dE1.dE3.5IXP Ad vector genome
catcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacgcgatcgcggtactgaaatgtgtgggcgtggcttaagggtgggaaagaatatataaggtgggggtcttatgtagttttgtatctgttttgcagcagccgccgccgccatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaagatggcatgcgagttggaggagatggtgggcctttggaagatgttgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatttgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcgaaagggttggggcacctcggcccggttgttgatgacctgggcggcgagcacgatctcgtcgaagccgttgatgttgtggcccacgatgtaaagttccacgaatcgcgggcggcccttgacgtggggcagtttcttgagctcctcgtaggtgagctcgtcggggtcgctgagtccgtgctgctcgagcgcccagtcggcgagatgggggttggcgcggaggaaggaagtccaaagatccacggccagggcggtttgcaggcggtcccggtattgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagtggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgcttcggcttccatgtcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccagccgctccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctcctcttcttcttccacctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatatagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgtttttttggccttggtcactggtcatgaaaaactagtaagcgcggaaagcgaccgcccgcgatggctcgctgccgtagtctggagaaagaatcgccagggttgcgttgcggtgtgccccggttcgagcctcggcgctcggcgccggccggattccgcggctaacgtgggcgtggctgccccgtcgtttccaagaccccttagccagccgacttctccagttacggagcgagcccctctttttttcttgtgtttttgccagatgcatcccgtactgcggcagatgcgcccccaccctccaccacaaccgcccctaccgcagcagcagcagcagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcgtcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcatgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaagtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcaaaagatcccaccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccggccgcgagggtgctgccgcggcggttcccgaggccgccagtcctttcccgagcttgcccttctcgctgaacagtattcgcagcagcgagctggggaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccacgagccggggcagcgccgcccgtaaacgccggtggcacgacaggcagcgggggctgatgtgggacgatgaggattccgccgacgacagcagcgtgttggacttgggtgggagtggtggtaacccgttcgctcacctgcgcccccgcatcgggcgcatgatgtaagagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatacgtatgatggtagtcaggatatcttggagtatgaatgggtggagtttgagctacccgaaggcaacttctcggtgaccatgaccatcgacctgatgaacaacgccatcatcgacaattacttggcggtggggcggcagaacggggtcctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtgcgcccgcccgcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcttgcgcgcgcccagcaagatgtacggaggcgctcgccaacgctccacgcaacaccccgtgcgcgtgcgcgggcacttccgcgctccctggggtgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacggactggtggagtttgtgcgcgagttcgcccccaggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaaaatccccacggagcccatggaaacacagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatcaatggccctcacatgccgcctccgcgttcccattacgggctaccgaggaagaaaaccgcgccgtagaaggctggcggggaacgggatgcgtcgccaccaccaccggaggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgaaccgcccccgtacgaggaggcggtgaaactgggtctgcccaccacgcggcccatcgcgcccctggccaccggggtgctgaaacccgaaaagcccgcgaccctggacttgcctccgccttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaattccagccagtgggagcaaaatgaaaacaatggtcaaggtcaagctaagacacacacctatggtgttgctgctatgggcggacttgatattacaaaagagggtcttcaaattggaactgatgctagtaagaaaaatgacaatgaaatttatgccgataaaacatatcagccagagcctcaaataggagaggaaaattggcaagacactgaaaacttttatggaggcagagctcttaaaaaagataccaagatgaagccatgctatggctcatttgccagacctaccaatgtgaagggagggcaagccaaagtgaaaacagaagaaaatgttcagtcattcgacataaatctggctttctttgatattccaagcaccggcacggggggcaatggtacaaatgtagatgataagccagacatggtcatgtacactgaaaatgtgaatctggagacgccagatactcatattgtgtacaaacctggaacttcagatgacagctctgaagccaacttgtgccagcaggccatgccaaacagacctaactacattggtttcagagacaactttattgggctcatgtattacaacagtactggcaatatgggggtgctggctggtcaggcctctcagttgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaaccacggtgtggaagatgaacttcccaactattgcttcccattggatggagctggtactaatgctgtttaccagggtgttaaagaaaaaactggcaataatggcaagtgggaagcagataccaatgttgcctctcagaaccagatatgcaagggtaacatctatgccatggaaatcaacctccaagccaacctgtggagaagttttctctactcgaacgtggccctgtacctgcccgattcttacaagtacacgccggccaacatcaccctgcccactaacaccaatacctatgattacatgaacgggagagtggtgcctccctcgctggtggacgcctacatcaacatcggggcgcgctggtcgttggaccccatggacaacgtcaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccactcatcggcaaaagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgctacttgcatgatgactgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaacaatcaagacatgtaacactgtgtgtatgtttaaaatatctttaataaacagcactttaatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccattccgaagggggtcatcttgcaggtctgccttcccatagtgggcacgcacccgggcttgtggttgcaatcgcagtgcagggggatcagcatcatctgggcctggtcggcgttcattcccgggtacatggccttcatgaacgcctccaattgcctgaacgcctgctgggccttggctccctcggtgaagaagaccccgcaggacttgctagagaactggttggtagcgcacccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggtctcggtgcatccgtgcagccacagcgcgcacccggtgcactcccagttcttgtgggcgatctgggaatgcgcgtgcacgaacccctgcaggaagcggcccatcatggtcgtcagggtcttgttgctagtgaaggtcagcgggatgccgcggtgctcctcgttgatgtacaggtagcagatgcggcggtacacctcgccctgctcgggcatcagctggaagttggctttcaggtcggtctccacgcggtagcggtccatcagcatagtcatgatttccatgcccttctcccaggccgagacgatgggcaggctcatagggttcttcaccatcatcttagcactagcagccgcagccagggggtcgctctcgtccagggtctcaaagctccgcttgccgtccttctcggtgatccgtaccggggggtagctgaagcccacggccgccagctcctcctcggcctgcctttcgtcctcgctgtcctggctgacgtcctgcaggaccacatgcttggtcttgcggggtttcttcttgggcggcagcggcggcggagatgctggagatggcgagggggagcgcgagttctcgctcaccactactatctcttcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagaatgaaagcttaaccgccccgccgcccagccccgcctccgacgcgcccgtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccgacaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgcatccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcggaccgccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaattaaaaacgtcacccgccccgcccctaacggtcgccttcgtcacagccaatcaccttcctccctccccaaattcaaacacctcatttgcatattaacgcgcaccaaaagtttgaggtatattattgatgatg

SEQ ID NO: 30 - DNA, 30489 bp, Artificial Sequence
  BB24.dE1.dE3 Ad vector genome
catcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgcgatcgccatatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcacttaggttgtcagtttctagaaacgaggaggatttgatattgacggtgccggcggagatgcctttcaagagcccctcgtccatctggtcagaaaagacgatctttttattgtcgagtttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtaggggctgaggggcgtgccccatggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcggctgggcttttcggcacggtagacgatctggcggaagatggcatgcgagttggaggagatggtgggcctttggaagatattgaagtgggcgtggggcaggccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatatagaactggttgacggccttgtaggcacagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaaaccgttgatgttgtggcccacgatgtagagttccacgaaccgcgggcggcccttgacgtggggcagcttcttgagctcctcgtaggtgagctcgtcggggtcgctgagtccgtgctgctcgagcgcccagtcggcgagatgggggttggcgcggaggaaggaagtccagagatccacggccagggcggtttgcagacggtctcggtactgccggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggggtgaccaccgtcccccgtttcttcttgggcggcggtggtggttcgacttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtgacgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggtttccgcggctaacgagggcgtggctgccccgtcgtttccaagaccccatagccagccgacttctccagttacggagcgagcccctcttttgttttttgtttttgccagatgcatcccgtactgcggcagatgcgcccccaccctccaccgcaacaacagccccctcctccgcagccggcgcttctgcccccgccccagcagcagcaacttccagccacgaccgccgcggccgccgtgagcggggctggacagacttctcagtatgatcacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggatgaaggcgaggatgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcactgctggagcgcgtggcccgctacaacagcaccaacgtgcagaccaacctggaccgcatggttaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctttgaggctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgtcgaggaggagcgcatcctgcgatacgtgcagcaaagcgtgggcctgttcctgatgcaggagggggccacccccagcgccgcgctcgacatgaccgcacgcaacatggagcccagcatgtacgccagcaaccgcccgttcatcaataagctgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggtcgcgagggtgctgccgcggcggtgcccgaggccgccagtccttttcccagcttgcccttctcgctgaacagtatccgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccggtctcagggggccgcgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatgactatgatggtagtcaggatgagctgaagtatgaatgggtggagtttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcccttccaggaaggtttccagatcatgtacgaggatctggaggggggcaacatccccgcgctcctggatgtcgaggcctatgaggacagtaaggaaaaagcagaagccgaggcgactgcagccgtggctaccgccgcaaccaatgcagatgccaatgtgactagaggcgatacattcgccactcaggcggaggaagcagccgccctagcggtcgccgatgatagtgaaagtaagatagtcattcagccggtgaagaaggatagcaagaacagaagctacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcctgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacaccccagccgccgcgcccgtctccaccgtggacgccgtcatcgacagcgtggtggccgacgcgcgccggtacgcccgcgccaagagtcggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagaaagtgatgtggacggactggtggagtttgtgcgcgagttcgccccccggcggcgcgtgcagtggcgcgggcggaaagtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgagcgcggcgccacgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcgacccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccactcgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtagatggcctggcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtaaaactgggtctgcccaccacgcggcccatcgcgcccctggccaccggggtgctgaaacccgaaagtaataagcccgcgaccctggacttgcctcctgcttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggctcccaagggagcacccaattccagccagtgggagcaagcaaagacaggcaataacaatggaaatgggggcactgaatctgttacctttggtgtagccgccatgggcggagggaatattacaaaagagggtcttcaaattggaagtgatgaaactaaaaccgataacaaagaaatttatgcagacaagacctaccaacctgagcctcaaataggagaggagaactggcaagaaacattctctttttatggcggtagagctcttaagaaagatactaagatgaagccatgctatggctcctttgctagacccacaaatgaaaagggaggtcaggccaagtttaaagttcaagacggccagcagactacagactatgacatcgacctggctttctttgatattcccaactctggcacaggaggcaatggtacaaatgttaattatgacccagatatggttatgtatactgaaaatgtgaatctggaaacaccagacacgcatgtggtatacaaacccggaacttcagatgacagttctgaagccaacttgcttcagcagtccatgcctaacagacccaactacattggatttagggacaactttattgggctcatgtattacaacagcactggaaatatgggggtgctggctggtcaggcctcccagctgaatgccgtggtggacttgcaagacagaaacacagagctgtcataccagctcttgcttgactctctgggtgacagaaccaggtatttcagtatgtggaatcaggcggtggacagttatgaccctgatgtgcgcatcattgaaaaccatggtgtggaggatgaattgccaaactattgcttccccttggatggagctggtactaatgctgtataccagggtgttaaagcaaaagataacggaaacgcagccaatggaaattgggaaaaagacacagacgtttcgagtattaaccagatatgcaaggggaacatttatgccatggaaatcaacattcaagccaacctgtggagaagtttcctctactcgaatgtggctctgtacctgcccgattcttacaagtacacgccggccaacattaccctgcccaccaataccaacacctacgattacatgaatgggagagtggtgcctccctcgctggtggacgcctacatcaacatcggggcgcgctggtcgctggaccccatggacaacgtcaatcccttcaaccaccaccgcaatgcggggctgcgctaccgctccatgctcctgggcaacgggcgcttcgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctccgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcgtcgagaaggccaccgccttcgaccgcatggacaatcaagacatgtaacactgtgtgtatgttaaaatatgttttaataaacagcactttaatgttacacatgcatctgagatggtttattatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccagctgacggaacgcctgctgggccttggctccctcggtgaagaagaccccgcaggacttgctagagaactggttggtggcacagccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggcctcggtgcagccgtgcagccacagagcgcacccggtgcactcccagttcttgtgggcgatctgggaatgtgcgtgcacgaagccctgcaggaagcggcccatcatggtcgtcagggtcttgttgctagtgaaggtcagcgggatgccgcggtgctcctcgttgatgtacaggtggcagatgcggcggtacacctcgccctgctcgggcatcagttggaagttggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcatccagggtctcaaagctccgcttgccgtccttctcggtgatccgcaccggggggtagctgaagcccacggccgccagctcctcctcggcctgtctttcgtcctcgctgtcctggctgacgtcctgcatgaccacatgcttggtcttgcggggtttcttcttgggcggcagtggcggcggagatgcttgtggcgagggggagcgcgagttctcgctcaccactactatctcttcctcttcttggtccgatgccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccggcgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccggcaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggccccggcgcccgcctacctgatatcgcctccttggaagaggttccaaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcaccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgctgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcggaccgccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgctattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcgactttcaaattccgtcgaccgttaattaaaaacgtcacccgccccgcccctaacggtcgccgctctctcggccaatcacagccccacatccccaaattcaaacgcctcatttgcatattaacgcgcacaaaaaagtttgaggtatattattgatgatg

SEQ ID NO: 31 - DNA, 30111 bp, Artificial Sequence
  BB24.dE1.dE3.5IXP Ad vector genome
catcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgcgatcgcggtactgaaatgtgtgggcgtggcttaagggtgggaaagaatatataaggtgggggtcttatgtagttttgtatctgttttgcagcagccgccgccgccatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcacttaggttgtcagtttctagaaacgaggaggatttgatattgacggtgccggcggagatgcctttcaagagcccctcgtccatctggtcagaaaagacgatctttttattgtcgagtttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtaggggctgaggggcgtgccccatggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcggctgggcttttcggcacggtagacgatctggcggaagatggcatgcgagttggaggagatggtgggcctttggaagatattgaagtgggcgtggggcaggccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatatagaactggttgacggccttgtaggcacagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaaaccgttgatgttgtggcccacgatgtagagttccacgaaccgcgggcggcccttgacgtggggcagcttcttgagctcctcgtaggtgagctcgtcggggtcgctgagtccgtgctgctcgagcgcccagtcggcgagatgggggttggcgcggaggaaggaagtccagagatccacggccagggcggtttgcagacggtctcggtactgccggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggggtgaccaccgtcccccgtttcttcttgggcggcggtggtggttcgacttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtgacgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggtttccgcggctaacgagggcgtggctgccccgtcgtttccaagaccccatagccagccgacttctccagttacggagcgagcccctcttttgttttttgtttttgccagatgcatcccgtactgcggcagatgcgcccccaccctccaccgcaacaacagccccctcctccgcagccggcgcttctgcccccgccccagcagcagcaacttccagccacgaccgccgcggccgccgtgagcggggctggacagacttctcagtatgatcacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggatgaaggcgaggatgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcactgctggagcgcgtggcccgctacaacagcaccaacgtgcagaccaacctggaccgcatggttaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctttgaggctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgtcgaggaggagcgcatcctgcgatacgtgcagcaaagcgtgggcctgttcctgatgcaggagggggccacccccagcgccgcgctcgacatgaccgcacgcaacatggagcccagcatgtacgccagcaaccgcccgttcatcaataagctgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggtcgcgagggtgctgccgcggcggtgcccgaggccgccagtccttttcccagcttgcccttctcgctgaacagtatccgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccggtctcagggggccgcgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatgactatgatggtagtcaggatgagctgaagtatgaatgggtggagtttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcccttccaggaaggtttccagatcatgtacgaggatctggaggggggcaacatccccgcgctcctggatgtcgaggcctatgaggacagtaaggaaaaagcagaagccgaggcgactgcagccgtggctaccgccgcaaccaatgcagatgccaatgtgactagaggcgatacattcgccactcaggcggaggaagcagccgccctagcggtcgccgatgatagtgaaagtaagatagtcattcagccggtgaagaaggatagcaagaacagaagctacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcctgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacaccccagccgccgcgcccgtctccaccgtggacgccgtcatcgacagcgtggtggccgacgcgcgccggtacgcccgcgccaagagtcggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagaaagtgatgtggacggactggtggagtttgtgcgcgagttcgccccccggcggcgcgtgcagtggcgcgggcggaaagtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgagcgcggcgccacgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcgacccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccactcgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtagatggcctggcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtaaaactgggtctgcccaccacgcggcccatcgcgcccctggccaccggggtgctgaaacccgaaagtaataagcccgcgaccctggacttgcctcctgcttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggctcccaagggagcacccaattccagccagtgggagcaagcaaagacaggcaataacaatggaaatgggggcactgaatctgttacctttggtgtagccgccatgggcggagggaatattacaaaagagggtcttcaaattggaagtgatgaaactaaaaccgataacaaagaaatttatgcagacaagacctaccaacctgagcctcaaataggagaggagaactggcaagaaacattctctttttatggcggtagagctcttaagaaagatactaagatgaagccatgctatggctcctttgctagacccacaaatgaaaagggaggtcaggccaagtttaaagttcaagacggccagcagactacagactatgacatcgacctggctttctttgatattcccaactctggcacaggaggcaatggtacaaatgttaattatgacccagatatggttatgtatactgaaaatgtgaatctggaaacaccagacacgcatgtggtatacaaacccggaacttcagatgacagttctgaagccaacttgcttcagcagtccatgcctaacagacccaactacattggatttagggacaactttattgggctcatgtattacaacagcactggaaatatgggggtgctggctggtcaggcctcccagctgaatgccgtggtggacttgcaagacagaaacacagagctgtcataccagctcttgcttgactctctgggtgacagaaccaggtatttcagtatgtggaatcaggcggtggacagttatgaccctgatgtgcgcatcattgaaaaccatggtgtggaggatgaattgccaaactattgcttccccttggatggagctggtactaatgctgtataccagggtgttaaagcaaaagataacggaaacgcagccaatggaaattgggaaaaagacacagacgtttcgagtattaaccagatatgcaaggggaacatttatgccatggaaatcaacattcaagccaacctgtggagaagtttcctctactcgaatgtggctctgtacctgcccgattcttacaagtacacgccggccaacattaccctgcccaccaataccaacacctacgattacatgaatgggagagtggtgcctccctcgctggtggacgcctacatcaacatcggggcgcgctggtcgctggaccccatggacaacgtcaatcccttcaaccaccaccgcaatgcggggctgcgctaccgctccatgctcctgggcaacgggcgcttcgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctccgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcgtcgagaaggccaccgccttcgaccgcatggacaatcaagacatgtaacactgtgtgtatgttaaaatatgttttaataaacagcactttaatgttacacatgcatctgagatggtttattatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccagctgacggaacgcctgctgggccttggctccctcggtgaagaagaccccgcaggacttgctagagaactggttggtggcacagccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggcctcggtgcagccgtgcagccacagagcgcacccggtgcactcccagttcttgtgggcgatctgggaatgtgcgtgcacgaagccctgcaggaagcggcccatcatggtcgtcagggtcttgttgctagtgaaggtcagcgggatgccgcggtgctcctcgttgatgtacaggtggcagatgcggcggtacacctcgccctgctcgggcatcagttggaagttggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcatccagggtctcaaagctccgcttgccgtccttctcggtgatccgcaccggggggtagctgaagcccacggccgccagctcctcctcggcctgtctttcgtcctcgctgtcctggctgacgtcctgcatgaccacatgcttggtcttgcggggtttcttcttgggcggcagtggcggcggagatgcttgtggcgagggggagcgcgagttctcgctcaccactactatctcttcctcttcttggtccgatgccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccggcgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccggcaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggccccggcgcccgcctacctgatatcgcctccttggaagaggttccaaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcaccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgctgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcggaccgccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgctattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcgactttcaaattccgtcgaccgttaattaaaaacgtcacccgccccgcccctaacggtcgccgctctctcggccaatcacagccccacatccccaaattcaaacgcctcatttgcatattaacgcgcacaaaaaagtttgaggtatattattgatgatg

SEQ ID NO: 32 - DNA, 1164 bp, Artificial Sequence
  HAdV-5 E4 orf 6/7
tcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcat

SEQ ID NO: 33 - DNA, 3576 bp, Artificial Sequence
  BB21 vector genome right end
gaattcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaattaaaaacgtcacccgccccgcccctaacggtcgccttcgtcacagccaatcaccttcctccctccccaaattcaaacacctcatttgcatattaacgcgcaccaaaagtttgaggtatattattgatgatgatttaaatattaat

SEQ ID NO: 34 - DNA, 4256 bp, Artificial Sequence
  BB21 vector genome left end
tacgtaatttaaatcatcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacgcgatcgctatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgcgagctgtcggcctgcgtcatcacccagggggcgatcctggcccaattgcaagccatccagaaatcccgccaagaattc

SEQ ID NO: 35 - DNA, 4077 bp, Artificial Sequence
  BB21 vector genome middle
gaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcggaccgccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaac

SEQ ID NO: 36 - DNA, 13845 bp, Artificial Sequence
  BB21 intermediate plasmid 3
catcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacgcgatcgctatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgcgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcggaccgccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaattaaaaacgtcacccgccccgcccctaacggtcgccttcgtcacagccaatcaccttcctccctccccaaattcaaacacctcatttgcatattaacgcgcaccaaaagtttgaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtaatttaaat

SEQ ID NO: 37 - DNA, 224 bp, Artificial Sequence
  Ad5 pIX promoter
cgcgatcgcggtactgaaatgtgtgggcgtggcttaagggtgggaaagaatatataaggtgggggtcttatgtagttttgtatctgttttgcagcagccgccgccgccatgagcggaagcggctcctttgagggaggggtattcagcccttatctgacggggcgtctcccctcctgggcgggagtgcgtcagaatgtgatgggatctacggtggacggccggcc

SEQ ID NO: 38 - DNA, 35181 bp, Artificial Sequence
  pBB21.FLuc
catcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgctatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaagatggcatgcgagttggaggagatggtgggcctttggaagatgttgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatttgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcgaaagggttggggcacctcggcccggttgttgatgacctgggcggcgagcacgatctcgtcgaagccgttgatgttgtggcccacgatgtaaagttccacgaatcgcgggcggcccttgacgtggggcagtttcttgagctcctcgtaggtgagctcgtcggggtcgctgagtccgtgctgctcgagcgcccagtcggcgagatgggggttggcgcggaggaaggaagtccaaagatccacggccagggcggtttgcaggcggtcccggtattgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagtggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgcttcggcttccatgtcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccagccgctccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctcctcttcttcttccacctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatatagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgtttttttggccttggtcactggtcatgaaaaactagtaagcgcggaaagcgaccgcccgcgatggctcgctgccgtagtctggagaaagaatcgccagggttgcgttgcggtgtgccccggttcgagcctcggcgctcggcgccggccggattccgcggctaacgtgggcgtggctgccccgtcgtttccaagaccccttagccagccgacttctccagttacggagcgagcccctctttttttcttgtgtttttgccagatgcatcccgtactgcggcagatgcgcccccaccctccaccacaaccgcccctaccgcagcagcagcagcagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcgtcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcatgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaagtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcaaaagatcccaccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccggccgcgagggtgctgccgcggcggttcccgaggccgccagtcctttcccgagcttgcccttctcgctgaacagtattcgcagcagcgagctggggaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccacgagccggggcagcgccgcccgtaaacgccggtggcacgacaggcagcgggggctgatgtgggacgatgaggattccgccgacgacagcagcgtgttggacttgggtgggagtggtggtaacccgttcgctcacctgcgcccccgcatcgggcgcatgatgtaagagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatacgtatgatggtagtcaggatatcttggagtatgaatgggtggagtttgagctacccgaaggcaacttctcggtgaccatgaccatcgacctgatgaacaacgccatcatcgacaattacttggcggtggggcggcagaacggggtcctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtgcgcccgcccgcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcttgcgcgcgcccagcaagatgtacggaggcgctcgccaacgctccacgcaacaccccgtgcgcgtgcgcgggcacttccgcgctccctggggtgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacggactggtggagtttgtgcgcgagttcgcccccaggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaaaatccccacggagcccatggaaacacagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatcaatggccctcacatgccgcctccgcgttcccattacgggctaccgaggaagaaaaccgcgccgtagaaggctggcggggaacgggatgcgtcgccaccaccaccggaggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgaaccgcccccgtacgaggaggcggtgaaactgggtctgcccaccacgcggcccatcgcgcccctggccaccggggtgctgaaacccgaaaagcccgcgaccctggacttgcctccgccttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaattccagccagtgggagcaaaatgaaaacaatggtcaaggtcaagctaagacacacacctatggtgttgctgctatgggcggacttgatattacaaaagagggtcttcaaattggaactgatgctagtaagaaaaatgacaatgaaatttatgccgataaaacatatcagccagagcctcaaataggagaggaaaattggcaagacactgaaaacttttatggaggcagagctcttaaaaaagataccaagatgaagccatgctatggctcatttgccagacctaccaatgtgaagggagggcaagccaaagtgaaaacagaagaaaatgttcagtcattcgacataaatctggctttctttgatattccaagcaccggcacggggggcaatggtacaaatgtagatgataagccagacatggtcatgtacactgaaaatgtgaatctggagacgccagatactcatattgtgtacaaacctggaacttcagatgacagctctgaagccaacttgtgccagcaggccatgccaaacagacctaactacattggtttcagagacaactttattgggctcatgtattacaacagtactggcaatatgggggtgctggctggtcaggcctctcagttgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaaccacggtgtggaagatgaacttcccaactattgcttcccattggatggagctggtactaatgctgtttaccagggtgttaaagaaaaaactggcaataatggcaagtgggaagcagataccaatgttgcctctcagaaccagatatgcaagggtaacatctatgccatggaaatcaacctccaagccaacctgtggagaagttttctctactcgaacgtggccctgtacctgcccgattcttacaagtacacgccggccaacatcaccctgcccactaacaccaatacctatgattacatgaacgggagagtggtgcctccctcgctggtggacgcctacatcaacatcggggcgcgctggtcgttggaccccatggacaacgtcaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccactcatcggcaaaagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgctacttgcatgatgactgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaacaatcaagacatgtaacactgtgtgtatgtttaaaatatctttaataaacagcactttaatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccattccgaagggggtcatcttgcaggtctgccttcccatagtgggcacgcacccgggcttgtggttgcaatcgcagtgcagggggatcagcatcatctgggcctggtcggcgttcattcccgggtacatggccttcatgaacgcctccaattgcctgaacgcctgctgggccttggctccctcggtgaagaagaccccgcaggacttgctagagaactggttggtagcgcacccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggtctcggtgcatccgtgcagccacagcgcgcacccggtgcactcccagttcttgtgggcgatctgggaatgcgcgtgcacgaacccctgcaggaagcggcccatcatggtcgtcagggtcttgttgctagtgaaggtcagcgggatgccgcggtgctcctcgttgatgtacaggtagcagatgcggcggtacacctcgccctgctcgggcatcagctggaagttggctttcaggtcggtctccacgcggtagcggtccatcagcatagtcatgatttccatgcccttctcccaggccgagacgatgggcaggctcatagggttcttcaccatcatcttagcactagcagccgcagccagggggtcgctctcgtccagggtctcaaagctccgcttgccgtccttctcggtgatccgtaccggggggtagctgaagcccacggccgccagctcctcctcggcctgcctttcgtcctcgctgtcctggctgacgtcctgcaggaccacatgcttggtcttgcggggtttcttcttgggcggcagcggcggcggagatgctggagatggcgagggggagcgcgagttctcgctcaccactactatctcttcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagaatgaaagcttaaccgccccgccgcccagccccgcctccgacgcgcccgtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccgacaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgcatccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcggaccgccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaattaaaaacgtcacccgccccgcccctaacggtcgccttcgtcacagccaatcaccttcctccctccccaaattcaaacacctcatttgcatattaacgcgcaccaaaagtttgaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtaatttaaat

SEQ ID NO: 39 - DNA, 36173 bp, Artificial Sequence
  pBB21.RSVF-2A-GLuc
catcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttcgtcgacatggaactgctgatcctgaaggccaacgccatcaccaccatcctgaccgccgtgaccttctgcttcgccagcggccagaacatcaccgaggaattctaccagagcacctgtagcgccgtgtccaagggctacctgagcgccctgcggaccggctggtacaccagcgtgatcaccatcgagctgagcaacatcaaaaagaacaagtgcaacggcaccgacgccaaaatcaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggcttcctgctgggcgtgggcagcgccattgctagcggagtggctgtgtctaaggtgctgcacctggaaggcgaagtgaacaagatcaagtccgccctgctgagcaccaacaaggccgtggtgtccctgagcaacggcgtgtccgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgcgagttcagcgtgaacgccggcgtgaccacccccgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgataatgccggcagcgtgtcattctttccacaagccgagacatgcaaggtgcagagcaaccgggtgttctgcgacaccatgaacagcctgaccctgcccagcgaggtgaacctgtgcaacgtggacatcttcaaccctaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcgtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtcaacgagaagatcaaccagagcctggccttcatcagaaagagcgacgagctgctgcacaatgtgaatgccgtgaagtccaccaccaatatcatgatcaccacaatcatcatcgtgatcatcgtcatcctgctgtccctgatcgccgtgggcctgctgctgtactgcaaggcccggtccacccctgtgaccctgtccaaggaccagctgagcggcatcaacaatatcgccttctccaacggacgcgtgaccgagctgctttaccggatgaagcgggctgagacatattgcccgagacccctgttggcaatccatcctactgaggctcgccacaaacagaaaatcgtggcccccgtcaaacagacactcaattttgacttgttgaaacttgcaggagatgttgagtcaaaccccgggcctatgggcgtcaaggtcctgttcgctctgatttgtatcgctgtcgctgaagctaagccaaccgagaataatgaagactttaatatcgtggccgtggcttctaacttcgctaccacagacctggatgcagacaggggaaagctgccaggcaagaaactgcccctggaggtcctgaaggagatggaagcaaatgcccggaaagccgggtgcacaagaggatgcctgatttgtctgagccacatcaagtgcactcctaagatgaagaagttcatccccggccggtgccatacctacgagggcgataaggaatccgcccagggaggaatcggagaggctatcgtggatattcccgaaatccctggcttcaaagacctggagcccatggaacagtttattgcacaggtggatctgtgcgtcgactgtactaccggatgcctgaagggactggcaaacgtccagtgtagcgacctgctgaagaaatggctgcctcagcgatgtgctacatttgccagcaagattcagggccaggtggacaagattaagggagcaggaggcgactgataattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgctatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaagatggcatgcgagttggaggagatggtgggcctttggaagatgttgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatttgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcgaaagggttggggcacctcggcccggttgttgatgacctgggcggcgagcacgatctcgtcgaagccgttgatgttgtggcccacgatgtaaagttccacgaatcgcgggcggcccttgacgtggggcagtttcttgagctcctcgtaggtgagctcgtcggggtcgctgagtccgtgctgctcgagcgcccagtcggcgagatgggggttggcgcggaggaaggaagtccaaagatccacggccagggcggtttgcaggcggtcccggtattgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagtggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgcttcggcttccatgtcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccagccgctccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctcctcttcttcttccacctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatatagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgtttttttggccttggtcactggtcatgaaaaactagtaagcgcggaaagcgaccgcccgcgatggctcgctgccgtagtctggagaaagaatcgccagggttgcgttgcggtgtgccccggttcgagcctcggcgctcggcgccggccggattccgcggctaacgtgggcgtggctgccccgtcgtttccaagaccccttagccagccgacttctccagttacggagcgagcccctctttttttcttgtgtttttgccagatgcatcccgtactgcggcagatgcgcccccaccctccaccacaaccgcccctaccgcagcagcagcagcagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcgtcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcatgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaagtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcaaaagatcccaccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccggccgcgagggtgctgccgcggcggttcccgaggccgccagtcctttcccgagcttgcccttctcgctgaacagtattcgcagcagcgagctggggaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccacgagccggggcagcgccgcccgtaaacgccggtggcacgacaggcagcgggggctgatgtgggacgatgaggattccgccgacgacagcagcgtgttggacttgggtgggagtggtggtaacccgttcgctcacctgcgcccccgcatcgggcgcatgatgtaagagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatacgtatgatggtagtcaggatatcttggagtatgaatgggtggagtttgagctacccgaaggcaacttctcggtgaccatgaccatcgacctgatgaacaacgccatcatcgacaattacttggcggtggggcggcagaacggggtcctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtgcgcccgcccgcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcttgcgcgcgcccagcaagatgtacggaggcgctcgccaacgctccacgcaacaccccgtgcgcgtgcgcgggcacttccgcgctccctggggtgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacggactggtggagtttgtgcgcgagttcgcccccaggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaaaatccccacggagcccatggaaacacagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatcaatggccctcacatgccgcctccgcgttcccattacgggctaccgaggaagaaaaccgcgccgtagaaggctggcggggaacgggatgcgtcgccaccaccaccggaggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgaaccgcccccgtacgaggaggcggtgaaactgggtctgcccaccacgcggcccatcgcgcccctggccaccggggtgctgaaacccgaaaagcccgcgaccctggacttgcctccgccttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaattccagccagtgggagcaaaatgaaaacaatggtcaaggtcaagctaagacacacacctatggtgttgctgctatgggcggacttgatattacaaaagagggtcttcaaattggaactgatgctagtaagaaaaatgacaatgaaatttatgccgataaaacatatcagccagagcctcaaataggagaggaaaattggcaagacactgaaaacttttatggaggcagagctcttaaaaaagataccaagatgaagccatgctatggctcatttgccagacctaccaatgtgaagggagggcaagccaaagtgaaaacagaagaaaatgttcagtcattcgacataaatctggctttctttgatattccaagcaccggcacggggggcaatggtacaaatgtagatgataagccagacatggtcatgtacactgaaaatgtgaatctggagacgccagatactcatattgtgtacaaacctggaacttcagatgacagctctgaagccaacttgtgccagcaggccatgccaaacagacctaactacattggtttcagagacaactttattgggctcatgtattacaacagtactggcaatatgggggtgctggctggtcaggcctctcagttgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaaccacggtgtggaagatgaacttcccaactattgcttcccattggatggagctggtactaatgctgtttaccagggtgttaaagaaaaaactggcaataatggcaagtgggaagcagataccaatgttgcctctcagaaccagatatgcaagggtaacatctatgccatggaaatcaacctccaagccaacctgtggagaagttttctctactcgaacgtggccctgtacctgcccgattcttacaagtacacgccggccaacatcaccctgcccactaacaccaatacctatgattacatgaacgggagagtggtgcctccctcgctggtggacgcctacatcaacatcggggcgcgctggtcgttggaccccatggacaacgtcaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccactcatcggcaaaagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgctacttgcatgatgactgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaacaatcaagacatgtaacactgtgtgtatgtttaaaatatctttaataaacagcactttaatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccattccgaagggggtcatcttgcaggtctgccttcccatagtgggcacgcacccgggcttgtggttgcaatcgcagtgcagggggatcagcatcatctgggcctggtcggcgttcattcccgggtacatggccttcatgaacgcctccaattgcctgaacgcctgctgggccttggctccctcggtgaagaagaccccgcaggacttgctagagaactggttggtagcgcacccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggtctcggtgcatccgtgcagccacagcgcgcacccggtgcactcccagttcttgtgggcgatctgggaatgcgcgtgcacgaacccctgcaggaagcggcccatcatggtcgtcagggtcttgttgctagtgaaggtcagcgggatgccgcggtgctcctcgttgatgtacaggtagcagatgcggcggtacacctcgccctgctcgggcatcagctggaagttggctttcaggtcggtctccacgcggtagcggtccatcagcatagtcatgatttccatgcccttctcccaggccgagacgatgggcaggctcatagggttcttcaccatcatcttagcactagcagccgcagccagggggtcgctctcgtccagggtctcaaagctccgcttgccgtccttctcggtgatccgtaccggggggtagctgaagcccacggccgccagctcctcctcggcctgcctttcgtcctcgctgtcctggctgacgtcctgcaggaccacatgcttggtcttgcggggtttcttcttgggcggcagcggcggcggagatgctggagatggcgagggggagcgcgagttctcgctcaccactactatctcttcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagaatgaaagcttaaccgccccgccgcccagccccgcctccgacgcgcccgtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccgacaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgcatccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcggaccgccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaattaaaaacgtcacccgccccgcccctaacggtcgccttcgtcacagccaatcaccttcctccctccccaaattcaaacacctcatttgcatattaacgcgcaccaaaagtttgaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtaatttaaat

SEQ ID NO: 40 - DNA, 33170 bp, Artificial Sequence
  BB21.FLuc Ad vector genome
catcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgctatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaagatggcatgcgagttggaggagatggtgggcctttggaagatgttgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatttgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcgaaagggttggggcacctcggcccggttgttgatgacctgggcggcgagcacgatctcgtcgaagccgttgatgttgtggcccacgatgtaaagttccacgaatcgcgggcggcccttgacgtggggcagtttcttgagctcctcgtaggtgagctcgtcggggtcgctgagtccgtgctgctcgagcgcccagtcggcgagatgggggttggcgcggaggaaggaagtccaaagatccacggccagggcggtttgcaggcggtcccggtattgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagtggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgcttcggcttccatgtcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccagccgctccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctcctcttcttcttccacctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatatagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgtttttttggccttggtcactggtcatgaaaaactagtaagcgcggaaagcgaccgcccgcgatggctcgctgccgtagtctggagaaagaatcgccagggttgcgttgcggtgtgccccggttcgagcctcggcgctcggcgccggccggattccgcggctaacgtgggcgtggctgccccgtcgtttccaagaccccttagccagccgacttctccagttacggagcgagcccctctttttttcttgtgtttttgccagatgcatcccgtactgcggcagatgcgcccccaccctccaccacaaccgcccctaccgcagcagcagcagcagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcgtcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcatgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaagtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcaaaagatcccaccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccggccgcgagggtgctgccgcggcggttcccgaggccgccagtcctttcccgagcttgcccttctcgctgaacagtattcgcagcagcgagctggggaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccacgagccggggcagcgccgcccgtaaacgccggtggcacgacaggcagcgggggctgatgtgggacgatgaggattccgccgacgacagcagcgtgttggacttgggtgggagtggtggtaacccgttcgctcacctgcgcccccgcatcgggcgcatgatgtaagagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatacgtatgatggtagtcaggatatcttggagtatgaatgggtggagtttgagctacccgaaggcaacttctcggtgaccatgaccatcgacctgatgaacaacgccatcatcgacaattacttggcggtggggcggcagaacggggtcctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtgcgcccgcccgcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcttgcgcgcgcccagcaagatgtacggaggcgctcgccaacgctccacgcaacaccccgtgcgcgtgcgcgggcacttccgcgctccctggggtgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacggactggtggagtttgtgcgcgagttcgcccccaggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaaaatccccacggagcccatggaaacacagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatcaatggccctcacatgccgcctccgcgttcccattacgggctaccgaggaagaaaaccgcgccgtagaaggctggcggggaacgggatgcgtcgccaccaccaccggaggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgaaccgcccccgtacgaggaggcggtgaaactgggtctgcccaccacgcggcccatcgcgcccctggccaccggggtgctgaaacccgaaaagcccgcgaccctggacttgcctccgccttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaattccagccagtgggagcaaaatgaaaacaatggtcaaggtcaagctaagacacacacctatggtgttgctgctatgggcggacttgatattacaaaagagggtcttcaaattggaactgatgctagtaagaaaaatgacaatgaaatttatgccgataaaacatatcagccagagcctcaaataggagaggaaaattggcaagacactgaaaacttttatggaggcagagctcttaaaaaagataccaagatgaagccatgctatggctcatttgccagacctaccaatgtgaagggagggcaagccaaagtgaaaacagaagaaaatgttcagtcattcgacataaatctggctttctttgatattccaagcaccggcacggggggcaatggtacaaatgtagatgataagccagacatggtcatgtacactgaaaatgtgaatctggagacgccagatactcatattgtgtacaaacctggaacttcagatgacagctctgaagccaacttgtgccagcaggccatgccaaacagacctaactacattggtttcagagacaactttattgggctcatgtattacaacagtactggcaatatgggggtgctggctggtcaggcctctcagttgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaaccacggtgtggaagatgaacttcccaactattgcttcccattggatggagctggtactaatgctgtttaccagggtgttaaagaaaaaactggcaataatggcaagtgggaagcagataccaatgttgcctctcagaaccagatatgcaagggtaacatctatgccatggaaatcaacctccaagccaacctgtggagaagttttctctactcgaacgtggccctgtacctgcccgattcttacaagtacacgccggccaacatcaccctgcccactaacaccaatacctatgattacatgaacgggagagtggtgcctccctcgctggtggacgcctacatcaacatcggggcgcgctggtcgttggaccccatggacaacgtcaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccactcatcggcaaaagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgctacttgcatgatgactgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaacaatcaagacatgtaacactgtgtgtatgtttaaaatatctttaataaacagcactttaatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccattccgaagggggtcatcttgcaggtctgccttcccatagtgggcacgcacccgggcttgtggttgcaatcgcagtgcagggggatcagcatcatctgggcctggtcggcgttcattcccgggtacatggccttcatgaacgcctccaattgcctgaacgcctgctgggccttggctccctcggtgaagaagaccccgcaggacttgctagagaactggttggtagcgcacccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggtctcggtgcatccgtgcagccacagcgcgcacccggtgcactcccagttcttgtgggcgatctgggaatgcgcgtgcacgaacccctgcaggaagcggcccatcatggtcgtcagggtcttgttgctagtgaaggtcagcgggatgccgcggtgctcctcgttgatgtacaggtagcagatgcggcggtacacctcgccctgctcgggcatcagctggaagttggctttcaggtcggtctccacgcggtagcggtccatcagcatagtcatgatttccatgcccttctcccaggccgagacgatgggcaggctcatagggttcttcaccatcatcttagcactagcagccgcagccagggggtcgctctcgtccagggtctcaaagctccgcttgccgtccttctcggtgatccgtaccggggggtagctgaagcccacggccgccagctcctcctcggcctgcctttcgtcctcgctgtcctggctgacgtcctgcaggaccacatgcttggtcttgcggggtttcttcttgggcggcagcggcggcggagatgctggagatggcgagggggagcgcgagttctcgctcaccactactatctcttcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagaatgaaagcttaaccgccccgccgcccagccccgcctccgacgcgcccgtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccgacaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgcatccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcggaccgccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaattaaaaacgtcacccgccccgcccctaacggtcgccttcgtcacagccaatcaccttcctccctccccaaattcaaacacctcatttgcatattaacgcgcaccaaaagtttgaggtatattattgatgatg

SEQ ID NO: 41 - DNA, 34162 bp, Artificial Sequence
  BB21.RSVF-2A-GLuc Ad vector genome
catcatcaataatatacctcaaacttttggtgcgcgttaatatgcaaatgaggtgtttgaatttggggagggaggaaggtgattggctgtgacgaaggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccaagggccgagtagactttgaccgattacgtgggggtttcgattaccgtatttttcacctaaatttccgcgtacggtgtcaaagtccggtgtttttacggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttcgtcgacatggaactgctgatcctgaaggccaacgccatcaccaccatcctgaccgccgtgaccttctgcttcgccagcggccagaacatcaccgaggaattctaccagagcacctgtagcgccgtgtccaagggctacctgagcgccctgcggaccggctggtacaccagcgtgatcaccatcgagctgagcaacatcaaaaagaacaagtgcaacggcaccgacgccaaaatcaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggcttcctgctgggcgtgggcagcgccattgctagcggagtggctgtgtctaaggtgctgcacctggaaggcgaagtgaacaagatcaagtccgccctgctgagcaccaacaaggccgtggtgtccctgagcaacggcgtgtccgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgcgagttcagcgtgaacgccggcgtgaccacccccgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgataatgccggcagcgtgtcattctttccacaagccgagacatgcaaggtgcagagcaaccgggtgttctgcgacaccatgaacagcctgaccctgcccagcgaggtgaacctgtgcaacgtggacatcttcaaccctaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcgtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtcaacgagaagatcaaccagagcctggccttcatcagaaagagcgacgagctgctgcacaatgtgaatgccgtgaagtccaccaccaatatcatgatcaccacaatcatcatcgtgatcatcgtcatcctgctgtccctgatcgccgtgggcctgctgctgtactgcaaggcccggtccacccctgtgaccctgtccaaggaccagctgagcggcatcaacaatatcgccttctccaacggacgcgtgaccgagctgctttaccggatgaagcgggctgagacatattgcccgagacccctgttggcaatccatcctactgaggctcgccacaaacagaaaatcgtggcccccgtcaaacagacactcaattttgacttgttgaaacttgcaggagatgttgagtcaaaccccgggcctatgggcgtcaaggtcctgttcgctctgatttgtatcgctgtcgctgaagctaagccaaccgagaataatgaagactttaatatcgtggccgtggcttctaacttcgctaccacagacctggatgcagacaggggaaagctgccaggcaagaaactgcccctggaggtcctgaaggagatggaagcaaatgcccggaaagccgggtgcacaagaggatgcctgatttgtctgagccacatcaagtgcactcctaagatgaagaagttcatccccggccggtgccatacctacgagggcgataaggaatccgcccagggaggaatcggagaggctatcgtggatattcccgaaatccctggcttcaaagacctggagcccatggaacagtttattgcacaggtggatctgtgcgtcgactgtactaccggatgcctgaagggactggcaaacgtccagtgtagcgacctgctgaagaaatggctgcctcagcgatgtgctacatttgccagcaagattcagggccaggtggacaagattaagggagcaggaggcgactgataattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgctatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcaagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagagccgaccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtagggactgaggggcgtgccccaaggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaagatggcatgcgagttggaggagatggtgggcctttggaagatgttgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatttgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcgaaagggttggggcacctcggcccggttgttgatgacctgggcggcgagcacgatctcgtcgaagccgttgatgttgtggcccacgatgtaaagttccacgaatcgcgggcggcccttgacgtggggcagtttcttgagctcctcgtaggtgagctcgtcggggtcgctgagtccgtgctgctcgagcgcccagtcggcgagatgggggttggcgcggaggaaggaagtccaaagatccacggccagggcggtttgcaggcggtcccggtattgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagtggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgcttcggcttccatgtcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccagccgctccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctcctcttcttcttccacctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatatagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgtttttttggccttggtcactggtcatgaaaaactagtaagcgcggaaagcgaccgcccgcgatggctcgctgccgtagtctggagaaagaatcgccagggttgcgttgcggtgtgccccggttcgagcctcggcgctcggcgccggccggattccgcggctaacgtgggcgtggctgccccgtcgtttccaagaccccttagccagccgacttctccagttacggagcgagcccctctttttttcttgtgtttttgccagatgcatcccgtactgcggcagatgcgcccccaccctccaccacaaccgcccctaccgcagcagcagcagcagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcgtcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcatgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaagtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcaaaagatcccaccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccggccgcgagggtgctgccgcggcggttcccgaggccgccagtcctttcccgagcttgcccttctcgctgaacagtattcgcagcagcgagctggggaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccacgagccggggcagcgccgcccgtaaacgccggtggcacgacaggcagcgggggctgatgtgggacgatgaggattccgccgacgacagcagcgtgttggacttgggtgggagtggtggtaacccgttcgctcacctgcgcccccgcatcgggcgcatgatgtaagagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatacgtatgatggtagtcaggatatcttggagtatgaatgggtggagtttgagctacccgaaggcaacttctcggtgaccatgaccatcgacctgatgaacaacgccatcatcgacaattacttggcggtggggcggcagaacggggtcctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtgcgcccgcccgcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcttgcgcgcgcccagcaagatgtacggaggcgctcgccaacgctccacgcaacaccccgtgcgcgtgcgcgggcacttccgcgctccctggggtgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacggactggtggagtttgtgcgcgagttcgcccccaggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaaaatccccacggagcccatggaaacacagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatcaatggccctcacatgccgcctccgcgttcccattacgggctaccgaggaagaaaaccgcgccgtagaaggctggcggggaacgggatgcgtcgccaccaccaccggaggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgaaccgcccccgtacgaggaggcggtgaaactgggtctgcccaccacgcggcccatcgcgcccctggccaccggggtgctgaaacccgaaaagcccgcgaccctggacttgcctccgccttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaattccagccagtgggagcaaaatgaaaacaatggtcaaggtcaagctaagacacacacctatggtgttgctgctatgggcggacttgatattacaaaagagggtcttcaaattggaactgatgctagtaagaaaaatgacaatgaaatttatgccgataaaacatatcagccagagcctcaaataggagaggaaaattggcaagacactgaaaacttttatggaggcagagctcttaaaaaagataccaagatgaagccatgctatggctcatttgccagacctaccaatgtgaagggagggcaagccaaagtgaaaacagaagaaaatgttcagtcattcgacataaatctggctttctttgatattccaagcaccggcacggggggcaatggtacaaatgtagatgataagccagacatggtcatgtacactgaaaatgtgaatctggagacgccagatactcatattgtgtacaaacctggaacttcagatgacagctctgaagccaacttgtgccagcaggccatgccaaacagacctaactacattggtttcagagacaactttattgggctcatgtattacaacagtactggcaatatgggggtgctggctggtcaggcctctcagttgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaaccacggtgtggaagatgaacttcccaactattgcttcccattggatggagctggtactaatgctgtttaccagggtgttaaagaaaaaactggcaataatggcaagtgggaagcagataccaatgttgcctctcagaaccagatatgcaagggtaacatctatgccatggaaatcaacctccaagccaacctgtggagaagttttctctactcgaacgtggccctgtacctgcccgattcttacaagtacacgccggccaacatcaccctgcccactaacaccaatacctatgattacatgaacgggagagtggtgcctccctcgctggtggacgcctacatcaacatcggggcgcgctggtcgttggaccccatggacaacgtcaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccactcatcggcaaaagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgctacttgcatgatgactgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaacaatcaagacatgtaacactgtgtgtatgtttaaaatatctttaataaacagcactttaatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccattccgaagggggtcatcttgcaggtctgccttcccatagtgggcacgcacccgggcttgtggttgcaatcgcagtgcagggggatcagcatcatctgggcctggtcggcgttcattcccgggtacatggccttcatgaacgcctccaattgcctgaacgcctgctgggccttggctccctcggtgaagaagaccccgcaggacttgctagagaactggttggtagcgcacccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggtctcggtgcatccgtgcagccacagcgcgcacccggtgcactcccagttcttgtgggcgatctgggaatgcgcgtgcacgaacccctgcaggaagcggcccatcatggtcgtcagggtcttgttgctagtgaaggtcagcgggatgccgcggtgctcctcgttgatgtacaggtagcagatgcggcggtacacctcgccctgctcgggcatcagctggaagttggctttcaggtcggtctccacgcggtagcggtccatcagcatagtcatgatttccatgcccttctcccaggccgagacgatgggcaggctcatagggttcttcaccatcatcttagcactagcagccgcagccagggggtcgctctcgtccagggtctcaaagctccgcttgccgtccttctcggtgatccgtaccggggggtagctgaagcccacggccgccagctcctcctcggcctgcctttcgtcctcgctgtcctggctgacgtcctgcaggaccacatgcttggtcttgcggggtttcttcttgggcggcagcggcggcggagatgctggagatggcgagggggagcgcgagttctcgctcaccactactatctcttcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagaatgaaagcttaaccgccccgccgcccagccccgcctccgacgcgcccgtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccgacaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgcatccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccccacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcatcgtcgaagggggcctcgactcccacctgcttcggatcttcagccagcgaccgatcctggtcgagcgcgaacaaggacagacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtatctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcggaccgccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataaacatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaagccccggcgggctgcaaacttcctccacacgctgaaggggatgtcaaattcctcctgtcccacgatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattgataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgtagcagaacctggtccgggcgctgcacaccgatcgccggcggcggtctcgacgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaattaaaaacgtcacccgccccgcccctaacggtcgccttcgtcacagccaatcaccttcctccctccccaaattcaaacacctcatttgcatattaacgcgcaccaaaagtttgaggtatattattgatgatg

SEQ ID NO: 42 - DNA, 1164 bp, Artificial Sequence
  HAdV-5 E4 orf 6/7
tcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcat

SEQ ID NO: 43 - DNA, 8144 bp, Artificial Sequence
  BB24 left and right ends
caattgatttaaatcatcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgcgatcgccatatgctggccaccgtgcatgtggcttcccattcccgtaagccctggcccgagttcgagcacaatgtcatgaccaggtgcgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcggaccgccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgctattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcgactttcaaattccgtcgaccgttaattaaaaacgtcacccgccccgcccctaacggtcgccgctctctcggccaatcacagccccacatccccaaattcaaacgcctcatttgcatattaacgcgcacaaaaaagtttgaggtatattattgatgatgatttaaatattaat

SEQ ID NO: 44 - DNA, 10202 bp, Artificial Sequence
  BB24 intermediate plasmid 1
gaattgatttaaatcatcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgcgatcgccatatgctggccaccgtgcatgtggcttcccattcccgtaagccctggcccgagttcgagcacaatgtcatgaccaggtgcgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcggaccgccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgctattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcgactttcaaattccgtcgaccgttaattaaaaacgtcacccgccccgcccctaacggtcgccgctctctcggccaatcacagccccacatccccaaattcaaacgcctcatttgcatattaacgcgcacaaaaaagtttgaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaa

SEQ ID NO: 45 - DNA, 2671 bp, Artificial Sequence
  Ad5 pIX promoter
gcgatcgcggtactgaaatgtgtgggcgtggcttaagggtgggaaagaatatataaggtgggggtcttatgtagttttgtatctgttttgcagcagccgccgccgccatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcacttaggttgtcagtttctagagatcgatcgatcgatcgaattc

SEQ ID NO: 46 - DNA, 35245 bp, Artificial Sequence
  pBB24.FLuc
catcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcacttaggttgtcagtttctagaaacgaggaggatttgatattgacggtgccggcggagatgcctttcaagagcccctcgtccatctggtcagaaaagacgatctttttattgtcgagtttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtaggggctgaggggcgtgccccatggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcggctgggcttttcggcacggtagacgatctggcggaagatggcatgcgagttggaggagatggtgggcctttggaagatattgaagtgggcgtggggcaggccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatatagaactggttgacggccttgtaggcacagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaaaccgttgatgttgtggcccacgatgtagagttccacgaaccgcgggcggcccttgacgtggggcagcttcttgagctcctcgtaggtgagctcgtcggggtcgctgagtccgtgctgctcgagcgcccagtcggcgagatgggggttggcgcggaggaaggaagtccagagatccacggccagggcggtttgcagacggtctcggtactgccggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggggtgaccaccgtcccccgtttcttcttgggcggcggtggtggttcgacttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtgacgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggtttccgcggctaacgagggcgtggctgccccgtcgtttccaagaccccatagccagccgacttctccagttacggagcgagcccctcttttgttttttgtttttgccagatgcatcccgtactgcggcagatgcgcccccaccctccaccgcaacaacagccccctcctccgcagccggcgcttctgcccccgccccagcagcagcaacttccagccacgaccgccgcggccgccgtgagcggggctggacagacttctcagtatgatcacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggatgaaggcgaggatgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcactgctggagcgcgtggcccgctacaacagcaccaacgtgcagaccaacctggaccgcatggttaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctttgaggctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgtcgaggaggagcgcatcctgcgatacgtgcagcaaagcgtgggcctgttcctgatgcaggagggggccacccccagcgccgcgctcgacatgaccgcacgcaacatggagcccagcatgtacgccagcaaccgcccgttcatcaataagctgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggtcgcgagggtgctgccgcggcggtgcccgaggccgccagtccttttcccagcttgcccttctcgctgaacagtatccgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccggtctcagggggccgcgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatgactatgatggtagtcaggatgagctgaagtatgaatgggtggagtttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcccttccaggaaggtttccagatcatgtacgaggatctggaggggggcaacatccccgcgctcctggatgtcgaggcctatgaggacagtaaggaaaaagcagaagccgaggcgactgcagccgtggctaccgccgcaaccaatgcagatgccaatgtgactagaggcgatacattcgccactcaggcggaggaagcagccgccctagcggtcgccgatgatagtgaaagtaagatagtcattcagccggtgaagaaggatagcaagaacagaagctacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcctgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacaccccagccgccgcgcccgtctccaccgtggacgccgtcatcgacagcgtggtggccgacgcgcgccggtacgcccgcgccaagagtcggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagaaagtgatgtggacggactggtggagtttgtgcgcgagttcgccccccggcggcgcgtgcagtggcgcgggcggaaagtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgagcgcggcgccacgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcgacccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccactcgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtagatggcctggcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtaaaactgggtctgcccaccacgcggcccatcgcgcccctggccaccggggtgctgaaacccgaaagtaataagcccgcgaccctggacttgcctcctgcttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggctcccaagggagcacccaattccagccagtgggagcaagcaaagacaggcaataacaatggaaatgggggcactgaatctgttacctttggtgtagccgccatgggcggagggaatattacaaaagagggtcttcaaattggaagtgatgaaactaaaaccgataacaaagaaatttatgcagacaagacctaccaacctgagcctcaaataggagaggagaactggcaagaaacattctctttttatggcggtagagctcttaagaaagatactaagatgaagccatgctatggctcctttgctagacccacaaatgaaaagggaggtcaggccaagtttaaagttcaagacggccagcagactacagactatgacatcgacctggctttctttgatattcccaactctggcacaggaggcaatggtacaaatgttaattatgacccagatatggttatgtatactgaaaatgtgaatctggaaacaccagacacgcatgtggtatacaaacccggaacttcagatgacagttctgaagccaacttgcttcagcagtccatgcctaacagacccaactacattggatttagggacaactttattgggctcatgtattacaacagcactggaaatatgggggtgctggctggtcaggcctcccagctgaatgccgtggtggacttgcaagacagaaacacagagctgtcataccagctcttgcttgactctctgggtgacagaaccaggtatttcagtatgtggaatcaggcggtggacagttatgaccctgatgtgcgcatcattgaaaaccatggtgtggaggatgaattgccaaactattgcttccccttggatggagctggtactaatgctgtataccagggtgttaaagcaaaagataacggaaacgcagccaatggaaattgggaaaaagacacagacgtttcgagtattaaccagatatgcaaggggaacatttatgccatggaaatcaacattcaagccaacctgtggagaagtttcctctactcgaatgtggctctgtacctgcccgattcttacaagtacacgccggccaacattaccctgcccaccaataccaacacctacgattacatgaatgggagagtggtgcctccctcgctggtggacgcctacatcaacatcggggcgcgctggtcgctggaccccatggacaacgtcaatcccttcaaccaccaccgcaatgcggggctgcgctaccgctccatgctcctgggcaacgggcgcttcgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctccgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcgtcgagaaggccaccgccttcgaccgcatggacaatcaagacatgtaacactgtgtgtatgttaaaatatgttttaataaacagcactttaatgttacacatgcatctgagatggtttattatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccagctgacggaacgcctgctgggccttggctccctcggtgaagaagaccccgcaggacttgctagagaactggttggtggcacagccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggcctcggtgcagccgtgcagccacagagcgcacccggtgcactcccagttcttgtgggcgatctgggaatgtgcgtgcacgaagccctgcaggaagcggcccatcatggtcgtcagggtcttgttgctagtgaaggtcagcgggatgccgcggtgctcctcgttgatgtacaggtggcagatgcggcggtacacctcgccctgctcgggcatcagttggaagttggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcatccagggtctcaaagctccgcttgccgtccttctcggtgatccgcaccggggggtagctgaagcccacggccgccagctcctcctcggcctgtctttcgtcctcgctgtcctggctgacgtcctgcatgaccacatgcttggtcttgcggggtttcttcttgggcggcagtggcggcggagatgcttgtggcgagggggagcgcgagttctcgctcaccactactatctcttcctcttcttggtccgatgccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccggcgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccggcaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggccccggcgcccgcctacctgatatcgcctccttggaagaggttccaaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcaccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgctgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcggaccgccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgctattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcgactttcaaattccgtcgaccgttaattaaaaacgtcacccgccccgcccctaacggtcgccgctctctcggccaatcacagccccacatccccaaattcaaacgcctcatttgcatattaacgcgcacaaaaaagtttgaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgatttaaat

SEQ ID NO: 47 - DNA, 36237 bp, Artificial Sequence
  pBB24.RSVF-2A-GLuc
catcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaattgccgcgtacggtgtcaaagtccggtgtttttacgcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttcgtcgacatggaactgctgatcctgaaggccaacgccatcaccaccatcctgaccgccgtgaccttctgcttcgccagcggccagaacatcaccgaggaattctaccagagcacctgtagcgccgtgtccaagggctacctgagcgccctgcggaccggctggtacaccagcgtgatcaccatcgagctgagcaacatcaaaaagaacaagtgcaacggcaccgacgccaaaatcaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggcttcctgctgggcgtgggcagcgccattgctagcggagtggctgtgtctaaggtgctgcacctggaaggcgaagtgaacaagatcaagtccgccctgctgagcaccaacaaggccgtggtgtccctgagcaacggcgtgtccgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgcgagttcagcgtgaacgccggcgtgaccacccccgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgataatgccggcagcgtgtcattctttccacaagccgagacatgcaaggtgcagagcaaccgggtgttctgcgacaccatgaacagcctgaccctgcccagcgaggtgaacctgtgcaacgtggacatcttcaaccctaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcgtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtcaacgagaagatcaaccagagcctggccttcatcagaaagagcgacgagctgctgcacaatgtgaatgccgtgaagtccaccaccaatatcatgatcaccacaatcatcatcgtgatcatcgtcatcctgctgtccctgatcgccgtgggcctgctgctgtactgcaaggcccggtccacccctgtgaccctgtccaaggaccagctgagcggcatcaacaatatcgccttctccaacggacgcgtgaccgagctgctttaccggatgaagcgggctgagacatattgcccgagacccctgttggcaatccatcctactgaggctcgccacaaacagaaaatcgtggcccccgtcaaacagacactcaattttgacttgttgaaacttgcaggagatgttgagtcaaaccccgggcctatgggcgtcaaggtcctgttcgctctgatttgtatcgctgtcgctgaagctaagccaaccgagaataatgaagactttaatatcgtggccgtggcttctaacttcgctaccacagacctggatgcagacaggggaaagctgccaggcaagaaactgcccctggaggtcctgaaggagatggaagcaaatgcccggaaagccgggtgcacaagaggatgcctgatttgtctgagccacatcaagtgcactcctaagatgaagaagttcatccccggccggtgccatacctacgagggcgataaggaatccgcccagggaggaatcggagaggctatcgtggatattcccgaaatccctggcttcaaagacctggagcccatggaacagtttattgcacaggtggatctgtgcgtcgactgtactaccggatgcctgaagggactggcaaacgtccagtgtagcgacctgctgaagaaatggctgcctcagcgatgtgctacatttgccagcaagattcagggccaggtggacaagattaagggagcaggaggcgactgataattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcacttaggttgtcagtttctagaaacgaggaggatttgatattgacggtgccggcggagatgcctttcaagagcccctcgtccatctggtcagaaaagacgatctttttattgtcgagtttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtaggggctgaggggcgtgccccatggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcggctgggcttttcggcacggtagacgatctggcggaagatggcatgcgagttggaggagatggtgggcctttggaagatattgaagtgggcgtggggcaggccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatatagaactggttgacggccttgtaggcacagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaaaccgttgatgttgtggcccacgatgtagagttccacgaaccgcgggcggcccttgacgtggggcagcttcttgagctcctcgtaggtgagctcgtcggggtcgctgagtccgtgctgctcgagcgcccagtcggcgagatgggggttggcgcggaggaaggaagtccagagatccacggccagggcggtttgcagacggtctcggtactgccggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggggtgaccaccgtcccccgtttcttcttgggcggcggtggtggttcgacttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtgacgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggtttccgcggctaacgagggcgtggctgccccgtcgtttccaagaccccatagccagccgacttctccagttacggagcgagcccctcttttgttttttgtttttgccagatgcatcccgtactgcggcagatgcgcccccaccctccaccgcaacaacagccccctcctccgcagccggcgcttctgcccccgccccagcagcagcaacttccagccacgaccgccgcggccgccgtgagcggggctggacagacttctcagtatgatcacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggatgaaggcgaggatgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcactgctggagcgcgtggcccgctacaacagcaccaacgtgcagaccaacctggaccgcatggttaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctttgaggctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgtcgaggaggagcgcatcctgcgatacgtgcagcaaagcgtgggcctgttcctgatgcaggagggggccacccccagcgccgcgctcgacatgaccgcacgcaacatggagcccagcatgtacgccagcaaccgcccgttcatcaataagctgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggtcgcgagggtgctgccgcggcggtgcccgaggccgccagtccttttcccagcttgcccttctcgctgaacagtatccgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccggtctcagggggccgcgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatgactatgatggtagtcaggatgagctgaagtatgaatgggtggagtttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcccttccaggaaggtttccagatcatgtacgaggatctggaggggggcaacatccccgcgctcctggatgtcgaggcctatgaggacagtaaggaaaaagcagaagccgaggcgactgcagccgtggctaccgccgcaaccaatgcagatgccaatgtgactagaggcgatacattcgccactcaggcggaggaagcagccgccctagcggtcgccgatgatagtgaaagtaagatagtcattcagccggtgaagaaggatagcaagaacagaagctacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcctgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacaccccagccgccgcgcccgtctccaccgtggacgccgtcatcgacagcgtggtggccgacgcgcgccggtacgcccgcgccaagagtcggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagaaagtgatgtggacggactggtggagtttgtgcgcgagttcgccccccggcggcgcgtgcagtggcgcgggcggaaagtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgagcgcggcgccacgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcgacccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccactcgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtagatggcctggcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtaaaactgggtctgcccaccacgcggcccatcgcgcccctggccaccggggtgctgaaacccgaaagtaataagcccgcgaccctggacttgcctcctgcttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggctcccaagggagcacccaattccagccagtgggagcaagcaaagacaggcaataacaatggaaatgggggcactgaatctgttacctttggtgtagccgccatgggcggagggaatattacaaaagagggtcttcaaattggaagtgatgaaactaaaaccgataacaaagaaatttatgcagacaagacctaccaacctgagcctcaaataggagaggagaactggcaagaaacattctctttttatggcggtagagctcttaagaaagatactaagatgaagccatgctatggctcctttgctagacccacaaatgaaaagggaggtcaggccaagtttaaagttcaagacggccagcagactacagactatgacatcgacctggctttctttgatattcccaactctggcacaggaggcaatggtacaaatgttaattatgacccagatatggttatgtatactgaaaatgtgaatctggaaacaccagacacgcatgtggtatacaaacccggaacttcagatgacagttctgaagccaacttgcttcagcagtccatgcctaacagacccaactacattggatttagggacaactttattgggctcatgtattacaacagcactggaaatatgggggtgctggctggtcaggcctcccagctgaatgccgtggtggacttgcaagacagaaacacagagctgtcataccagctcttgcttgactctctgggtgacagaaccaggtatttcagtatgtggaatcaggcggtggacagttatgaccctgatgtgcgcatcattgaaaaccatggtgtggaggatgaattgccaaactattgcttccccttggatggagctggtactaatgctgtataccagggtgttaaagcaaaagataacggaaacgcagccaatggaaattgggaaaaagacacagacgtttcgagtattaaccagatatgcaaggggaacatttatgccatggaaatcaacattcaagccaacctgtggagaagtttcctctactcgaatgtggctctgtacctgcccgattcttacaagtacacgccggccaacattaccctgcccaccaataccaacacctacgattacatgaatgggagagtggtgcctccctcgctggtggacgcctacatcaacatcggggcgcgctggtcgctggaccccatggacaacgtcaatcccttcaaccaccaccgcaatgcggggctgcgctaccgctccatgctcctgggcaacgggcgcttcgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctccgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcgtcgagaaggccaccgccttcgaccgcatggacaatcaagacatgtaacactgtgtgtatgttaaaatatgttttaataaacagcactttaatgttacacatgcatctgagatggtttattatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccagctgacggaacgcctgctgggccttggctccctcggtgaagaagaccccgcaggacttgctagagaactggttggtggcacagccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggcctcggtgcagccgtgcagccacagagcgcacccggtgcactcccagttcttgtgggcgatctgggaatgtgcgtgcacgaagccctgcaggaagcggcccatcatggtcgtcagggtcttgttgctagtgaaggtcagcgggatgccgcggtgctcctcgttgatgtacaggtggcagatgcggcggtacacctcgccctgctcgggcatcagttggaagttggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcatccagggtctcaaagctccgcttgccgtccttctcggtgatccgcaccggggggtagctgaagcccacggccgccagctcctcctcggcctgtctttcgtcctcgctgtcctggctgacgtcctgcatgaccacatgcttggtcttgcggggtttcttcttgggcggcagtggcggcggagatgcttgtggcgagggggagcgcgagttctcgctcaccactactatctcttcctcttcttggtccgatgccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccggcgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccggcaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggccccggcgcccgcctacctgatatcgcctccttggaagaggttccaaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcaccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgctgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcggaccgccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgctattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcgactttcaaattccgtcgaccgttaattaaaaacgtcacccgccccgcccctaacggtcgccgctctctcggccaatcacagccccacatccccaaattcaaacgcctcatttgcatattaacgcgcacaaaaaagtttgaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgatttaaat

SEQ ID NO: 48 - DNA, 33159 bp, Artificial Sequence
  BB24.FLuc Ad vector genome
catcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcacttaggttgtcagtttctagaaacgaggaggatttgatattgacggtgccggcggagatgcctttcaagagcccctcgtccatctggtcagaaaagacgatctttttattgtcgagtttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtaggggctgaggggcgtgccccatggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcggctgggcttttcggcacggtagacgatctggcggaagatggcatgcgagttggaggagatggtgggcctttggaagatattgaagtgggcgtggggcaggccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatatagaactggttgacggccttgtaggcacagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaaaccgttgatgttgtggcccacgatgtagagttccacgaaccgcgggcggcccttgacgtggggcagcttcttgagctcctcgtaggtgagctcgtcggggtcgctgagtccgtgctgctcgagcgcccagtcggcgagatgggggttggcgcggaggaaggaagtccagagatccacggccagggcggtttgcagacggtctcggtactgccggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggggtgaccaccgtcccccgtttcttcttgggcggcggtggtggttcgacttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtgacgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggtttccgcggctaacgagggcgtggctgccccgtcgtttccaagaccccatagccagccgacttctccagttacggagcgagcccctcttttgttttttgtttttgccagatgcatcccgtactgcggcagatgcgcccccaccctccaccgcaacaacagccccctcctccgcagccggcgcttctgcccccgccccagcagcagcaacttccagccacgaccgccgcggccgccgtgagcggggctggacagacttctcagtatgatcacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggatgaaggcgaggatgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcactgctggagcgcgtggcccgctacaacagcaccaacgtgcagaccaacctggaccgcatggttaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctttgaggctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgtcgaggaggagcgcatcctgcgatacgtgcagcaaagcgtgggcctgttcctgatgcaggagggggccacccccagcgccgcgctcgacatgaccgcacgcaacatggagcccagcatgtacgccagcaaccgcccgttcatcaataagctgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggtcgcgagggtgctgccgcggcggtgcccgaggccgccagtccttttcccagcttgcccttctcgctgaacagtatccgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccggtctcagggggccgcgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatgactatgatggtagtcaggatgagctgaagtatgaatgggtggagtttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcccttccaggaaggtttccagatcatgtacgaggatctggaggggggcaacatccccgcgctcctggatgtcgaggcctatgaggacagtaaggaaaaagcagaagccgaggcgactgcagccgtggctaccgccgcaaccaatgcagatgccaatgtgactagaggcgatacattcgccactcaggcggaggaagcagccgccctagcggtcgccgatgatagtgaaagtaagatagtcattcagccggtgaagaaggatagcaagaacagaagctacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcctgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacaccccagccgccgcgcccgtctccaccgtggacgccgtcatcgacagcgtggtggccgacgcgcgccggtacgcccgcgccaagagtcggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagaaagtgatgtggacggactggtggagtttgtgcgcgagttcgccccccggcggcgcgtgcagtggcgcgggcggaaagtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgagcgcggcgccacgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcgacccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccactcgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtagatggcctggcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtaaaactgggtctgcccaccacgcggcccatcgcgcccctggccaccggggtgctgaaacccgaaagtaataagcccgcgaccctggacttgcctcctgcttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggctcccaagggagcacccaattccagccagtgggagcaagcaaagacaggcaataacaatggaaatgggggcactgaatctgttacctttggtgtagccgccatgggcggagggaatattacaaaagagggtcttcaaattggaagtgatgaaactaaaaccgataacaaagaaatttatgcagacaagacctaccaacctgagcctcaaataggagaggagaactggcaagaaacattctctttttatggcggtagagctcttaagaaagatactaagatgaagccatgctatggctcctttgctagacccacaaatgaaaagggaggtcaggccaagtttaaagttcaagacggccagcagactacagactatgacatcgacctggctttctttgatattcccaactctggcacaggaggcaatggtacaaatgttaattatgacccagatatggttatgtatactgaaaatgtgaatctggaaacaccagacacgcatgtggtatacaaacccggaacttcagatgacagttctgaagccaacttgcttcagcagtccatgcctaacagacccaactacattggatttagggacaactttattgggctcatgtattacaacagcactggaaatatgggggtgctggctggtcaggcctcccagctgaatgccgtggtggacttgcaagacagaaacacagagctgtcataccagctcttgcttgactctctgggtgacagaaccaggtatttcagtatgtggaatcaggcggtggacagttatgaccctgatgtgcgcatcattgaaaaccatggtgtggaggatgaattgccaaactattgcttccccttggatggagctggtactaatgctgtataccagggtgttaaagcaaaagataacggaaacgcagccaatggaaattgggaaaaagacacagacgtttcgagtattaaccagatatgcaaggggaacatttatgccatggaaatcaacattcaagccaacctgtggagaagtttcctctactcgaatgtggctctgtacctgcccgattcttacaagtacacgccggccaacattaccctgcccaccaataccaacacctacgattacatgaatgggagagtggtgcctccctcgctggtggacgcctacatcaacatcggggcgcgctggtcgctggaccccatggacaacgtcaatcccttcaaccaccaccgcaatgcggggctgcgctaccgctccatgctcctgggcaacgggcgcttcgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctccgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcgtcgagaaggccaccgccttcgaccgcatggacaatcaagacatgtaacactgtgtgtatgttaaaatatgttttaataaacagcactttaatgttacacatgcatctgagatggtttattatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccagctgacggaacgcctgctgggccttggctccctcggtgaagaagaccccgcaggacttgctagagaactggttggtggcacagccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggcctcggtgcagccgtgcagccacagagcgcacccggtgcactcccagttcttgtgggcgatctgggaatgtgcgtgcacgaagccctgcaggaagcggcccatcatggtcgtcagggtcttgttgctagtgaaggtcagcgggatgccgcggtgctcctcgttgatgtacaggtggcagatgcggcggtacacctcgccctgctcgggcatcagttggaagttggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcatccagggtctcaaagctccgcttgccgtccttctcggtgatccgcaccggggggtagctgaagcccacggccgccagctcctcctcggcctgtctttcgtcctcgctgtcctggctgacgtcctgcatgaccacatgcttggtcttgcggggtttcttcttgggcggcagtggcggcggagatgcttgtggcgagggggagcgcgagttctcgctcaccactactatctcttcctcttcttggtccgatgccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccggcgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccggcaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggccccggcgcccgcctacctgatatcgcctccttggaagaggttccaaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcaccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgctgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcggaccgccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgctattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcgactttcaaattccgtcgaccgttaattaaaaacgtcacccgccccgcccctaacggtcgccgctctctcggccaatcacagccccacatccccaaattcaaacgcctcatttgcatattaacgcgcacaaaaaagtttgaggtatattattgatgatg

SEQ ID NO: 49 - DNA, 34151 bp, Artificial Sequence
  BB24.RSVF-2A-GLuc Ad vector genome
catcatcaataatatacctcaaacttttttgtgcgcgttaatatgcaaatgaggcgtttgaatttggggatgtggggctgtgattggccgagagagcggcgaccgttaggggcggggcgggtgacgttttgatgacgtgtttgtgaggcggagccggtttgcaagttctcgtgggaaaagtgacgtcaaacgaggtgtggtttgaacacgcaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaattgccgcgtacggtgtcaaagtccggtgtttttacgcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttcgtcgacatggaactgctgatcctgaaggccaacgccatcaccaccatcctgaccgccgtgaccttctgcttcgccagcggccagaacatcaccgaggaattctaccagagcacctgtagcgccgtgtccaagggctacctgagcgccctgcggaccggctggtacaccagcgtgatcaccatcgagctgagcaacatcaaaaagaacaagtgcaacggcaccgacgccaaaatcaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggcttcctgctgggcgtgggcagcgccattgctagcggagtggctgtgtctaaggtgctgcacctggaaggcgaagtgaacaagatcaagtccgccctgctgagcaccaacaaggccgtggtgtccctgagcaacggcgtgtccgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgcgagttcagcgtgaacgccggcgtgaccacccccgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgataatgccggcagcgtgtcattctttccacaagccgagacatgcaaggtgcagagcaaccgggtgttctgcgacaccatgaacagcctgaccctgcccagcgaggtgaacctgtgcaacgtggacatcttcaaccctaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcgtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtcaacgagaagatcaaccagagcctggccttcatcagaaagagcgacgagctgctgcacaatgtgaatgccgtgaagtccaccaccaatatcatgatcaccacaatcatcatcgtgatcatcgtcatcctgctgtccctgatcgccgtgggcctgctgctgtactgcaaggcccggtccacccctgtgaccctgtccaaggaccagctgagcggcatcaacaatatcgccttctccaacggacgcgtgaccgagctgctttaccggatgaagcgggctgagacatattgcccgagacccctgttggcaatccatcctactgaggctcgccacaaacagaaaatcgtggcccccgtcaaacagacactcaattttgacttgttgaaacttgcaggagatgttgagtcaaaccccgggcctatgggcgtcaaggtcctgttcgctctgatttgtatcgctgtcgctgaagctaagccaaccgagaataatgaagactttaatatcgtggccgtggcttctaacttcgctaccacagacctggatgcagacaggggaaagctgccaggcaagaaactgcccctggaggtcctgaaggagatggaagcaaatgcccggaaagccgggtgcacaagaggatgcctgatttgtctgagccacatcaagtgcactcctaagatgaagaagttcatccccggccggtgccatacctacgagggcgataaggaatccgcccagggaggaatcggagaggctatcgtggatattcccgaaatccctggcttcaaagacctggagcccatggaacagtttattgcacaggtggatctgtgcgtcgactgtactaccggatgcctgaagggactggcaaacgtccagtgtagcgacctgctgaagaaatggctgcctcagcgatgtgctacatttgccagcaagattcagggccaggtggacaagattaagggagcaggaggcgactgataattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccaccgtgcatgtggcttcccattcccgtaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagtatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatccgctgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagttgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgtccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagagtgcccgattgggggacaaaggtaccctcgatcccgggggcgtagttcccctcacagatctgcatctcccaggctttgagctcggatggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacggctgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgtttcaggctcatccggctggtcgaaaaccgctcccgatcggcgccctgcgcgtcggccaggtagcaattgaccatgagttcgtagttgagcgcctcggccgcatggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccacggtcctcctcgtagaggaaccccgcccactccgagacgaaagcccgggtccaggccagcacgaaggaggccacgtgggacgggtagcggtcgttgtccaccagcgggtccactttctccagggtatgcaaacacatgtccccctcgtccacatccaggaaggtgattggcttgtaagtgtaggccacgtgaccgggggtcccggccgggggggtataaaagggggagggcccctgctcgtcctcactgtcttccggatcgctgtccaggagcgccagctgttggggtaggtattccctctcgaaggcgggcatgacctcggcacttaggttgtcagtttctagaaacgaggaggatttgatattgacggtgccggcggagatgcctttcaagagcccctcgtccatctggtcagaaaagacgatctttttattgtcgagtttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggaggtcggggtcgaagtagctgatggaagtggccagatcgtccagggcagcttgccattcgcgcacggccagcgcgcgctcgtaggggctgaggggcgtgccccatggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcggctgggcttttcggcacggtagacgatctggcggaagatggcatgcgagttggaggagatggtgggcctttggaagatattgaagtgggcgtggggcaggccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatatagaactggttgacggccttgtaggcacagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaaaccgttgatgttgtggcccacgatgtagagttccacgaaccgcgggcggcccttgacgtggggcagcttcttgagctcctcgtaggtgagctcgtcggggtcgctgagtccgtgctgctcgagcgcccagtcggcgagatgggggttggcgcggaggaaggaagtccagagatccacggccagggcggtttgcagacggtctcggtactgccggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggggtgaccaccgtcccccgtttcttcttgggcggcggtggtggttcgacttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtgacgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggtttccgcggctaacgagggcgtggctgccccgtcgtttccaagaccccatagccagccgacttctccagttacggagcgagcccctcttttgttttttgtttttgccagatgcatcccgtactgcggcagatgcgcccccaccctccaccgcaacaacagccccctcctccgcagccggcgcttctgcccccgccccagcagcagcaacttccagccacgaccgccgcggccgccgtgagcggggctggacagacttctcagtatgatcacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggatgaaggcgaggatgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcactgctggagcgcgtggcccgctacaacagcaccaacgtgcagaccaacctggaccgcatggttaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctttgaggctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgtcgaggaggagcgcatcctgcgatacgtgcagcaaagcgtgggcctgttcctgatgcaggagggggccacccccagcgccgcgctcgacatgaccgcacgcaacatggagcccagcatgtacgccagcaaccgcccgttcatcaataagctgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggtcgcgagggtgctgccgcggcggtgcccgaggccgccagtccttttcccagcttgcccttctcgctgaacagtatccgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccggtctcagggggccgcgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaatggggtcaaggtagatgatgactatgatggtagtcaggatgagctgaagtatgaatgggtggagtttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcccttccaggaaggtttccagatcatgtacgaggatctggaggggggcaacatccccgcgctcctggatgtcgaggcctatgaggacagtaaggaaaaagcagaagccgaggcgactgcagccgtggctaccgccgcaaccaatgcagatgccaatgtgactagaggcgatacattcgccactcaggcggaggaagcagccgccctagcggtcgccgatgatagtgaaagtaagatagtcattcagccggtgaagaaggatagcaagaacagaagctacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcctgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacaccccagccgccgcgcccgtctccaccgtggacgccgtcatcgacagcgtggtggccgacgcgcgccggtacgcccgcgccaagagtcggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagaaagtgatgtggacggactggtggagtttgtgcgcgagttcgccccccggcggcgcgtgcagtggcgcgggcggaaagtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgccccgccctgaaggaagaggcggtgtccatcccgctggaccacggcaaccccacgccgagcctcaagcccgtgaccctgcagcaggtgctgccgagcgcggcgccacgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcgacccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcagccgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccactcgccgccgccgtcgccgcacaaccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtagatggcctggcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtaaaactgggtctgcccaccacgcggcccatcgcgcccctggccaccggggtgctgaaacccgaaagtaataagcccgcgaccctggacttgcctcctgcttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggctcccaagggagcacccaattccagccagtgggagcaagcaaagacaggcaataacaatggaaatgggggcactgaatctgttacctttggtgtagccgccatgggcggagggaatattacaaaagagggtcttcaaattggaagtgatgaaactaaaaccgataacaaagaaatttatgcagacaagacctaccaacctgagcctcaaataggagaggagaactggcaagaaacattctctttttatggcggtagagctcttaagaaagatactaagatgaagccatgctatggctcctttgctagacccacaaatgaaaagggaggtcaggccaagtttaaagttcaagacggccagcagactacagactatgacatcgacctggctttctttgatattcccaactctggcacaggaggcaatggtacaaatgttaattatgacccagatatggttatgtatactgaaaatgtgaatctggaaacaccagacacgcatgtggtatacaaacccggaacttcagatgacagttctgaagccaacttgcttcagcagtccatgcctaacagacccaactacattggatttagggacaactttattgggctcatgtattacaacagcactggaaatatgggggtgctggctggtcaggcctcccagctgaatgccgtggtggacttgcaagacagaaacacagagctgtcataccagctcttgcttgactctctgggtgacagaaccaggtatttcagtatgtggaatcaggcggtggacagttatgaccctgatgtgcgcatcattgaaaaccatggtgtggaggatgaattgccaaactattgcttccccttggatggagctggtactaatgctgtataccagggtgttaaagcaaaagataacggaaacgcagccaatggaaattgggaaaaagacacagacgtttcgagtattaaccagatatgcaaggggaacatttatgccatggaaatcaacattcaagccaacctgtggagaagtttcctctactcgaatgtggctctgtacctgcccgattcttacaagtacacgccggccaacattaccctgcccaccaataccaacacctacgattacatgaatgggagagtggtgcctccctcgctggtggacgcctacatcaacatcggggcgcgctggtcgctggaccccatggacaacgtcaatcccttcaaccaccaccgcaatgcggggctgcgctaccgctccatgctcctgggcaacgggcgcttcgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctccgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcgtcgagaaggccaccgccttcgaccgcatggacaatcaagacatgtaacactgtgtgtatgttaaaatatgttttaataaacagcactttaatgttacacatgcatctgagatggtttattatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccagctgacggaacgcctgctgggccttggctccctcggtgaagaagaccccgcaggacttgctagagaactggttggtggcacagccggcgtcgtgcacgcagcagcgcgcgtcgttgttggccagctgcaccacgctgcgcccccagcggttctgggtgatcttggcccggtcggggttctccttcagcgcgcgctgtccgttctcgctcgccacatccatctcgatcatgtgctccttctggatcatggtggtcccgtgcaggcaccgcagcttgccctcggcctcggtgcagccgtgcagccacagagcgcacccggtgcactcccagttcttgtgggcgatctgggaatgtgcgtgcacgaagccctgcaggaagcggcccatcatggtcgtcagggtcttgttgctagtgaaggtcagcgggatgccgcggtgctcctcgttgatgtacaggtggcagatgcggcggtacacctcgccctgctcgggcatcagttggaagttggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcatccagggtctcaaagctccgcttgccgtccttctcggtgatccgcaccggggggtagctgaagcccacggccgccagctcctcctcggcctgtctttcgtcctcgctgtcctggctgacgtcctgcatgaccacatgcttggtcttgcggggtttcttcttgggcggcagtggcggcggagatgcttgtggcgagggggagcgcgagttctcgctcaccactactatctcttcctcttcttggtccgatgccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccggcgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatggcgactacctccacctgagcggggaggaggacgcgctcatcaagcatctggcccggcaggccaccatcgtcaaggacgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggccccggcgcccgcctacctgatatcgcctccttggaagaggttccaaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggcccttaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaagctcatgatggccgtggtcctggtgaccgtggagctggagtgcctgcaccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcggaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttccgctgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccaccatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagtcagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccagtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccgggacctatcagtgcatctcgggaccctgccatcacaccttccacctgatcccgaataccacctcttccccagcgccgctccccactaacaaccaaactaaccaccaccgctaccgacgcggaccgccacaatacatgcccatcttagactatgaggccgagccacagcgagccatgcttcctgctattagttacttcaatctaaccggcggagatgactgaccctatggccaacaacaccgtcaacgaccttctggacatggacggccgcgcctcggagcagcgactcgcccaactccgcatccgccagcagcaggagagagccgtcaaggagctgcaggatgcggtggccatccaccagtgcaagagaggcatcttctgcctggtgaagcaagctaagatcaccttcgaggtgacttccaccgaccgtcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaaccccctttaccctccagtaaaaataaagattaaaaatgattgaattgatcaataaagaatcacttacttgaaatctgaaaccaggtctttgtccatgttttctgtcagcagcacttcactcccctcttcccaactctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgctattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataaaccaccctgcatgccaccccttgtcccactgctctacaatggaaaactctgaagcagaaaaaataaagttcaagtgttttattgattcaacagttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatatttataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtacttgctgaagcagaacctggtccgggcgctgcacaccgatcgccggcggcggtctcggcgcttggaacgctcggtgttgaagttgtaaaacagccactctctcagaccgtgcagcaaatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgggcaagcaattcttaagaaaatcaacaaaagaaaaatcctccaggtgcacgtttagaggctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaattcgactttcaaattccgtcgaccgttaattaaaaacgtcacccgccccgcccctaacggtcgccgctctctcggccaatcacagccccacatccccaaattcaaacgcctcatttgcatattaacgcgcacaaaaaagtttgaggtatattattgatgatg

SEQ ID NO: 50 - DNA, 1164 bp, Artificial Sequence
  HAdV-5 E4 orf 6/7
tcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcat

SEQ ID NO: 51 - DNA, 32409 bp, Artificial Sequence; identical to SEQ ID NO: 20
  Ad4.FLuc

SEQ ID NO: 52 - DNA, 36110 bp, Artificial Sequence
  pAd4.Ptr01.BB24.5orf6.RSVF-2A-GLuc
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttcgtcgacatggaactgctgatcctgaaggccaacgccatcaccaccatcctgaccgccgtgaccttctgcttcgccagcggccagaacatcaccgaggaattctaccagagcacctgtagcgccgtgtccaagggctacctgagcgccctgcggaccggctggtacaccagcgtgatcaccatcgagctgagcaacatcaaaaagaacaagtgcaacggcaccgacgccaaaatcaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggcttcctgctgggcgtgggcagcgccattgctagcggagtggctgtgtctaaggtgctgcacctggaaggcgaagtgaacaagatcaagtccgccctgctgagcaccaacaaggccgtggtgtccctgagcaacggcgtgtccgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgcgagttcagcgtgaacgccggcgtgaccacccccgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgataatgccggcagcgtgtcattctttccacaagccgagacatgcaaggtgcagagcaaccgggtgttctgcgacaccatgaacagcctgaccctgcccagcgaggtgaacctgtgcaacgtggacatcttcaaccctaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcgtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtcaacgagaagatcaaccagagcctggccttcatcagaaagagcgacgagctgctgcacaatgtgaatgccgtgaagtccaccaccaatatcatgatcaccacaatcatcatcgtgatcatcgtcatcctgctgtccctgatcgccgtgggcctgctgctgtactgcaaggcccggtccacccctgtgaccctgtccaaggaccagctgagcggcatcaacaatatcgccttctccaacggacgcgtgaccgagctgctttaccggatgaagcgggctgagacatattgcccgagacccctgttggcaatccatcctactgaggctcgccacaaacagaaaatcgtggcccccgtcaaacagacactcaattttgacttgttgaaacttgcaggagatgttgagtcaaaccccgggcctatgggcgtcaaggtcctgttcgctctgatttgtatcgctgtcgctgaagctaagccaaccgagaataatgaagactttaatatcgtggccgtggcttctaacttcgctaccacagacctggatgcagacaggggaaagctgccaggcaagaaactgcccctggaggtcctgaaggagatggaagcaaatgcccggaaagccgggtgcacaagaggatgcctgatttgtctgagccacatcaagtgcactcctaagatgaagaagttcatccccggccggtgccatacctacgagggcgataaggaatccgcccagggaggaatcggagaggctatcgtggatattcccgaaatccctggcttcaaagacctggagcccatggaacagtttattgcacaggtggatctgtgcgtcgactgtactaccggatgcctgaagggactggcaaacgtccagtgtagcgacctgctgaagaaatggctgcctcagcgatgtgctacatttgccagcaagattcagggccaggtggacaagattaagggagcaggaggcgactgataattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaatgctctggctcctaaagctgctcctaatccaagtcaatgggaagaaacttccacagatgctactactactactactcacagctttggcctggctgctatgaagggggacaatattacatctgacggtttgcagataggaacagatgctacttctggagaggaaaaacccatctatgcagataaactgtaccagccagaaccccaaataggggaagagtcatggactgatactgacggaaccaatgaaaaattcggaggaagagtccttaaaaaggacacaagcatgaaaccctgctacgggtcatttgccaagccaaccaataacaaaggtgggcaggcaaaacaaaaggcaacggaaggaaccactgtagaatatgatgttgacatgaacttttttgatggtagagatgcagctgctaactttactccagaagtagtgttgtatgctgaaaatgttgatttggaaactccagatacacatattgtatacaagccaggaacctcagatgtgagttcccatgtcaatttgggtcagcaagccatgcccaacagacccaactacattgggttcagggacaactttattgggctgatgtactacaacagcactggcaatatgggtgtgctggccggtcaggcctctcagctgaatgctgtggttgacttgcaagacagaaacaccgaactgtcttaccagctcttgcttgactctctgggtgacagaacccggtacttcagtatgtggaatcaggcggtggacagttatgatcctgatgtgcgcattattgaaaatcatggtatagaagatgagcttcccaactattgcttccccattgacgctgtgggtattactaaaacttatcaaggtatcaaaacgcaaaatggtcaaactacaacgtgggaaaaggacaccagtgttagtacggccaatgaaataggcattggcaacaatcttgctatggaaatcaacatccaagccaacctctggaggaacttcctctatgccaacgtggccctgtacctgcccgactcttacaagtacacgccggccaacgtcactctgcccaccaacaccaatacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattcatttaaat

SEQ ID NO: 53 - DNA, 30362 bp, Artificial Sequence
  Ad4Ptr01-BB24
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaatgctctggctcctaaagctgctcctaatccaagtcaatgggaagaaacttccacagatgctactactactactactcacagctttggcctggctgctatgaagggggacaatattacatctgacggtttgcagataggaacagatgctacttctggagaggaaaaacccatctatgcagataaactgtaccagccagaaccccaaataggggaagagtcatggactgatactgacggaaccaatgaaaaattcggaggaagagtccttaaaaaggacacaagcatgaaaccctgctacgggtcatttgccaagccaaccaataacaaaggtgggcaggcaaaacaaaaggcaacggaaggaaccactgtagaatatgatgttgacatgaacttttttgatggtagagatgcagctgctaactttactccagaagtagtgttgtatgctgaaaatgttgatttggaaactccagatacacatattgtatacaagccaggaacctcagatgtgagttcccatgtcaatttgggtcagcaagccatgcccaacagacccaactacattgggttcagggacaactttattgggctgatgtactacaacagcactggcaatatgggtgtgctggccggtcaggcctctcagctgaatgctgtggttgacttgcaagacagaaacaccgaactgtcttaccagctcttgcttgactctctgggtgacagaacccggtacttcagtatgtggaatcaggcggtggacagttatgatcctgatgtgcgcattattgaaaatcatggtatagaagatgagcttcccaactattgcttccccattgacgctgtgggtattactaaaacttatcaaggtatcaaaacgcaaaatggtcaaactacaacgtgggaaaaggacaccagtgttagtacggccaatgaaataggcattggcaacaatcttgctatggaaatcaacatccaagccaacctctggaggaacttcctctatgccaacgtggccctgtacctgcccgactcttacaagtacacgccggccaacgtcactctgcccaccaacaccaatacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatg

SEQ ID NO: 54 - DNA, 33032 bp, Artificial Sequence
  Ad4Ptr01-BB24.FLuc
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaatgctctggctcctaaagctgctcctaatccaagtcaatgggaagaaacttccacagatgctactactactactactcacagctttggcctggctgctatgaagggggacaatattacatctgacggtttgcagataggaacagatgctacttctggagaggaaaaacccatctatgcagataaactgtaccagccagaaccccaaataggggaagagtcatggactgatactgacggaaccaatgaaaaattcggaggaagagtccttaaaaaggacacaagcatgaaaccctgctacgggtcatttgccaagccaaccaataacaaaggtgggcaggcaaaacaaaaggcaacggaaggaaccactgtagaatatgatgttgacatgaacttttttgatggtagagatgcagctgctaactttactccagaagtagtgttgtatgctgaaaatgttgatttggaaactccagatacacatattgtatacaagccaggaacctcagatgtgagttcccatgtcaatttgggtcagcaagccatgcccaacagacccaactacattgggttcagggacaactttattgggctgatgtactacaacagcactggcaatatgggtgtgctggccggtcaggcctctcagctgaatgctgtggttgacttgcaagacagaaacaccgaactgtcttaccagctcttgcttgactctctgggtgacagaacccggtacttcagtatgtggaatcaggcggtggacagttatgatcctgatgtgcgcattattgaaaatcatggtatagaagatgagcttcccaactattgcttccccattgacgctgtgggtattactaaaacttatcaaggtatcaaaacgcaaaatggtcaaactacaacgtgggaaaaggacaccagtgttagtacggccaatgaaataggcattggcaacaatcttgctatggaaatcaacatccaagccaacctctggaggaacttcctctatgccaacgtggccctgtacctgcccgactcttacaagtacacgccggccaacgtcactctgcccaccaacaccaatacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaatagaagcacctctacaggtagtagacttactaaacactttagttgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaaccccattacaaacatagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgaaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatg

SEQ ID NO: 55 - DNA, 36110 bp, Artificial Sequence; identical to SEQ ID NO: 52
  Ad4Ptr01-BB24.RSVF-2A-GLuc

SEQ ID NO: 56 - DNA, 36134 bp, Artificial Sequence
  pAd4.Ptr13.BB21.5orf6.RSVF-2A-GLuc
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttcgtcgacatggaactgctgatcctgaaggccaacgccatcaccaccatcctgaccgccgtgaccttctgcttcgccagcggccagaacatcaccgaggaattctaccagagcacctgtagcgccgtgtccaagggctacctgagcgccctgcggaccggctggtacaccagcgtgatcaccatcgagctgagcaacatcaaaaagaacaagtgcaacggcaccgacgccaaaatcaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggcttcctgctgggcgtgggcagcgccattgctagcggagtggctgtgtctaaggtgctgcacctggaaggcgaagtgaacaagatcaagtccgccctgctgagcaccaacaaggccgtggtgtccctgagcaacggcgtgtccgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgcgagttcagcgtgaacgccggcgtgaccacccccgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgataatgccggcagcgtgtcattctttccacaagccgagacatgcaaggtgcagagcaaccgggtgttctgcgacaccatgaacagcctgaccctgcccagcgaggtgaacctgtgcaacgtggacatcttcaaccctaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcgtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtcaacgagaagatcaaccagagcctggccttcatcagaaagagcgacgagctgctgcacaatgtgaatgccgtgaagtccaccaccaatatcatgatcaccacaatcatcatcgtgatcatcgtcatcctgctgtccctgatcgccgtgggcctgctgctgtactgcaaggcccggtccacccctgtgaccctgtccaaggaccagctgagcggcatcaacaatatcgccttctccaacggacgcgtgaccgagctgctttaccggatgaagcgggctgagacatattgcccgagacccctgttggcaatccatcctactgaggctcgccacaaacagaaaatcgtggcccccgtcaaacagacactcaattttgacttgttgaaacttgcaggagatgttgagtcaaaccccgggcctatgggcgtcaaggtcctgttcgctctgatttgtatcgctgtcgctgaagctaagccaaccgagaataatgaagactttaatatcgtggccgtggcttctaacttcgctaccacagacctggatgcagacaggggaaagctgccaggcaagaaactgcccctggaggtcctgaaggagatggaagcaaatgcccggaaagccgggtgcacaagaggatgcctgatttgtctgagccacatcaagtgcactcctaagatgaagaagttcatccccggccggtgccatacctacgagggcgataaggaatccgcccagggaggaatcggagaggctatcgtggatattcccgaaatccctggcttcaaagacctggagcccatggaacagtttattgcacaggtggatctgtgcgtcgactgtactaccggatgcctgaagggactggcaaacgtccagtgtagcgacctgctgaagaaatggctgcctcagcgatgtgctacatttgccagcaagattcagggccaggtggacaagattaagggagcaggaggcgactgataattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagcacccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccaccaatgaaaagggaggacaggctaaacttaaagttggagatgatggagttccaaccaaagaatttgacatagacctggctttctttgatactcccggtggcactgtgaatggccaagatgagtataaagcagacattgtcatgtataccgaaaacgcctatctggaaactccagacacacatgtggtatacaaaccaggcaaggaagatgcaagttctgaaattaacctggttcagcagtccatgcccaacagacccaactacattgggttcagggacaactttattggtctcatgtattacaacagcactggcaatatgggggtgctggccggtcaggcctcacagctgaatgctgtggttgacttgcaagacagaaacactgagctgtcctaccagctcttgcttgactctctgggtgacagaacccggtatttcagtatgtggaatcaggcggtggacagttatgatcctgatgtgcgcattattgaaaaccatggtgtggaggatgaactgccaaactattgcttccccttggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggaaatcaacctccaagccaacctgtggaggagtttcctctactcgaacgtggccctgtacctgcccgactcttacaagtacacgccggccaacgtcaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaagcccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattcatttaaat

SEQ ID NO: 57 - DNA, 30386 bp, Artificial Sequence
  Ad4Ptr13-BB21
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagcacccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccaccaatgaaaagggaggacaggctaaacttaaagttggagatgatggagttccaaccaaagaatttgacatagacctggctttctttgatactcccggtggcactgtgaatggccaagatgagtataaagcagacattgtcatgtataccgaaaacgcctatctggaaactccagacacacatgtggtatacaaaccaggcaaggaagatgcaagttctgaaattaacctggttcagcagtccatgcccaacagacccaactacattgggttcagggacaactttattggtctcatgtattacaacagcactggcaatatgggggtgctggccggtcaggcctcacagctgaatgctgtggttgacttgcaagacagaaacactgagctgtcctaccagctcttgcttgactctctgggtgacagaacccggtatttcagtatgtggaatcaggcggtggacagttatgatcctgatgtgcgcattattgaaaaccatggtgtggaggatgaactgccaaactattgcttccccttggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggaaatcaacctccaagccaacctgtggaggagtttcctctactcgaacgtggccctgtacctgcccgactcttacaagtacacgccggccaacgtcaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaagcccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatg

SEQ ID NO: 58 - DNA, 33056 bp, Artificial Sequence
  Ad4Ptr13-BB21.FLuc
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagcacccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccaccaatgaaaagggaggacaggctaaacttaaagttggagatgatggagttccaaccaaagaatttgacatagacctggctttctttgatactcccggtggcactgtgaatggccaagatgagtataaagcagacattgtcatgtataccgaaaacgcctatctggaaactccagacacacatgtggtatacaaaccaggcaaggaagatgcaagttctgaaattaacctggttcagcagtccatgcccaacagacccaactacattgggttcagggacaactttattggtctcatgtattacaacagcactggcaatatgggggtgctggccggtcaggcctcacagctgaatgctgtggttgacttgcaagacagaaacactgagctgtcctaccagctcttgcttgactctctgggtgacagaacccggtatttcagtatgtggaatcaggcggtggacagttatgatcctgatgtgcgcattattgaaaaccatggtgtggaggatgaactgccaaactattgcttccccttggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggaaatcaacctccaagccaacctgtggaggagtttcctctactcgaacgtggccctgtacctgcccgactcttacaagtacacgccggccaacgtcaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaagcccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatg

SEQ ID NO: 59 - DNA, 34048 bp, Artificial Sequence
  Ad4Ptr13-BB21.RSVF-2A-GLuc
catcatcaataatataccttattttttttgtgtgagttaatatgcaaataaggcgtgaaaatttggggatggggcgcgctgattggctgtgacagcggcgttcgttaggggcggggcaggtgacgttttgatgacgcgactatgaggaggagttagtttgcaagttctggtggggaaaagtgacgtcaaacgaggtgtggtttaaacacggaaatactcaattttcccacgctgtctaacaggaaatgaggtgtttttgggcggatgcaagtgaaaacggaccattttcgcgcgaaaactgaatgaggaagtgaaatctgagtaatttagtgtttatgacagggaggagtatttgccgagggccgagtagactttgaccgtttacgtgggggtttcgattaccgtgtttttcacctaaagttccgcgtacggtgtcaaagtccggtgtttttacgtagggcgatcgctcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttcgtcgacatggaactgctgatcctgaaggccaacgccatcaccaccatcctgaccgccgtgaccttctgcttcgccagcggccagaacatcaccgaggaattctaccagagcacctgtagcgccgtgtccaagggctacctgagcgccctgcggaccggctggtacaccagcgtgatcaccatcgagctgagcaacatcaaaaagaacaagtgcaacggcaccgacgccaaaatcaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggcttcctgctgggcgtgggcagcgccattgctagcggagtggctgtgtctaaggtgctgcacctggaaggcgaagtgaacaagatcaagtccgccctgctgagcaccaacaaggccgtggtgtccctgagcaacggcgtgtccgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgcgagttcagcgtgaacgccggcgtgaccacccccgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgataatgccggcagcgtgtcattctttccacaagccgagacatgcaaggtgcagagcaaccgggtgttctgcgacaccatgaacagcctgaccctgcccagcgaggtgaacctgtgcaacgtggacatcttcaaccctaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcgtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtcaacgagaagatcaaccagagcctggccttcatcagaaagagcgacgagctgctgcacaatgtgaatgccgtgaagtccaccaccaatatcatgatcaccacaatcatcatcgtgatcatcgtcatcctgctgtccctgatcgccgtgggcctgctgctgtactgcaaggcccggtccacccctgtgaccctgtccaaggaccagctgagcggcatcaacaatatcgccttctccaacggacgcgtgaccgagctgctttaccggatgaagcgggctgagacatattgcccgagacccctgttggcaatccatcctactgaggctcgccacaaacagaaaatcgtggcccccgtcaaacagacactcaattttgacttgttgaaacttgcaggagatgttgagtcaaaccccgggcctatgggcgtcaaggtcctgttcgctctgatttgtatcgctgtcgctgaagctaagccaaccgagaataatgaagactttaatatcgtggccgtggcttctaacttcgctaccacagacctggatgcagacaggggaaagctgccaggcaagaaactgcccctggaggtcctgaaggagatggaagcaaatgcccggaaagccgggtgcacaagaggatgcctgatttgtctgagccacatcaagtgcactcctaagatgaagaagttcatccccggccggtgccatacctacgagggcgataaggaatccgcccagggaggaatcggagaggctatcgtggatattcccgaaatccctggcttcaaagacctggagcccatggaacagtttattgcacaggtggatctgtgcgtcgactgtactaccggatgcctgaagggactggcaaacgtccagtgtagcgacctgctgaagaaatggctgcctcagcgatgtgctacatttgccagcaagattcagggccaggtggacaagattaagggagcaggaggcgactgataattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgccatatgctggccgccgtgcatgtggcttcccattcccgcaagccctggcctgagttcgagcacaatgtcatgaccaggtgcaatatgcatctgggggctcgccgaggcatgtttatgccctaccagtgcaacctgaattatgtaaaggtgctcctggagcccgatgtcatgtccagagtgagcctgacgggggtgtttgacatgaatgtggaagtgtggaagattctaagatatgatgaatacaagaccaggtgtcgagcctgcgagtgcggagggaagcatgccaggttccagcccgtgtgtgtggatgtgacggaggacctgcgacccgatcatttggtgttgtcctgcaccgggacggagttcggctccagtggggaagaatctgactagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatgtgatgggatccacggtggacggccggcccgtacagcccgcgaactcttcaaccctgacctatgcaaccctgagctcctcgtcggtggacgcagctgccgccgcagctgctgcttctgccgccagcgccgtgcgcggaatggccatgggcgccggctattacggcactctggtggccaactcgagttccactaataatcccgccagcctgaacgaggagaagctgctgctgttgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaaaaatcagagtctgaatctttatttgatttttcgcgcacggtaggccctggaccaccggcctcgatcattgagcacccggtggatcttttccaagacccggtagaggtgggattggatattgaggtacatgggcatgagcccgtcccgggggtgaaggtagctccattgcagggcctcgtgctcgggggtggtgttgtaaatcacccagtcatagcagggacgcagggcgtggtgttgcacaatatctttgaggaggagactgatggccacgggcagccctttggtgtaggtgtttacaaacctgttgagctgggagggatgcatgcggggggagatgaggtgcatcttagcctggatcttcagattggcgatgttaccgcccagatcccgcctgggattcatgttgtgcaggaccaccagcacggtgtatccggtgcacttggggaatttgtcatgcaacttggaagggaaggcatgaaagaatttggagacgcccttgtggccgcccaggttttccatgcactcatccatgataatggctatgggcccgtgggcggcggcttgggcaaagacgtttcgggggtcggacacatcgtagttgtggtcctgggtgagatcttcataggccattttaatgaatttggggcggagggtgcccgattgggggacgaaggtaccctcaatcccgggggcgtagtttccctcacagatctgcatctcccaggccttaagctccgagggggggatcatgtccacctgcggggcgataaagaaaacggtttccggggcgggggagatgagctgggcggaaagcaggttgcggagtagctgggacttaccgcagccggtggggccgtagataaccccaatgaccggctgcaggtggtagttgagggagacacagctgccgtcctccctaagaaggggggccacctcgttcatcatttggcgcacgtgcatgttctcgcgcaccagttccgccaggagtcgctctccgcccagcgagaggagctcctggagcgaggcgaagtttttcagcggcttgagcccgtcggccatgggcattttggaaagggtctgttgcaggagttccaagcggtcccagagctcggtgatgtgctctacggcatctcgatccagcagacctcctcgtttcgcgggttggggcgactgcgggagtagggcgccagacgatgggcgtccagcgcggccagggtccggtccttccagggtcgcagcgtccgcgtcagggtggtctccgtcacggtaaaggggtgcgcgccgggctgggcgcttgcgagggtgcgcttcaggctcatccggctggtcgagaaccgctcccgatcggcgccctgtgcgtcggccaggtagcaattgaccatgagttcgtagttgagcgcctcggccgcgtggcctttggcgcggagcttacctttggaagtctgcccacaggcgggacagaggagggacttgagggcgtagagcttgggggcgaggaagacggactcgggggcgtaggcgtccgcgccgcagtgggcgcagacggtctcgcactccacgagccaggtgaggtcgggctgattgggatcaaaaaccagttttccgccgttctttttgatgcgtttcttacctctggtctccatgagctcgtgtccccgctgggtgacaaagaggctgtccgtgtccccgtaaaccgactttatgggtcggtcctcgagtgggacgccgcggtcctcgtcgtagaggaaacccgaccactctgagacgaaggcccgggtccaagccagcacgaaggaggccacgtgggagggatagcggtcgttatccaccagcgggtccaccttctccagtgtatgcaaacacatgtccccctcgtccacatccaggaaggtgattggcttgtaagtgtaggccacgtgaccgggggtcccggccgggggggtataaaagggggcgggccgctgctcgtcttcactgtcttccggatcgctgtccaggagcgccagctgttggggtaggtattccctctcaaaggcgggcatgacctccgcactcaggttgtcagtttctagaaacgaggaggatttgatattgacggtgccggcggagatgcctttcaagagcccctcgtccatctggtcagaaaagacaatctttttgttgtcgagtttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggttagctcgtctggcacgattctgacctgccagccccggttatgcagggtgatgaggtcaacgctggtggccacctcgccgcgcaggggctcgttggtccagcagaggcggccgcccttgcgcgagcagaaggggggcagggggtccagcataagctcgtcgggggggtcagcatcgatggtgaagatgcctggcaggaggtcggggtcgaagtagcttatgcaggtgcccagatcgtccagagaagcttgccattcgcgcacggccagcgcgcgctcgtagggactaaggggcgtgccccagggcatggggtgggtgagcgcggaggcgtacatgccgcagatgtcgtagacgtagaggggctcatcaaggatgccaatgtaggtggggtagcagcggcccccgcggatgctggcgcgcacgtagtcatacaactcgtgcgagggggcgaggagcccggctccgagattggcgcggctgggtttttcggcgcggtagacgatctgacggaagatggcgtgggagttggaggagatggtgggtctttggaagatgttgaagtgggcgtggggcaggccgaccgagtcgcggatgaagtgggcgtaggagtcttgcagcttggcgacaagctcggcggtgacgaggacgtccagggcgcagtagtcaagggtctcttggatgatgtcatacttgagctggcccttttgtttccacagctcgcggttgagaaggaactcttcgcggtccttccagtactcttcaagggggaacccgtcctggtcggcacggtaagagcctagcatgtagaactggttaacggccttgtaggcgcagcagcccttctccacggggagggcataggcctgggcggccttgcgcagggaggtgtgcgtgagggcgaaggtgtccctgaccatgacctttaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttaatgttgtggcccacaatgtatagttccacgaaccgcgggcggcccttgacgtggggcagtttcttgagctcctcgtaggtgagctcgtcggggtcgctgagcccgtgctgctcgagggcccagtcggcgagatgggggttggcgcggaggaaggaagtccagagatccacggccagggcggtttgcagacgatcccggtactggcggaactgctgacccacggccattttttcgggggtgacgcagtagaaggtgcgggggtcgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgaacattcgtgcttgtgtttatacaagcggccacagtgctcgcaacgctgcacgggatgcacgtgctgcacgagctgtacctgggttcctttgacgaggaatttcagtgggaagtggagtcgtggcgcctgcatctggtgctgtactacgtcgtggtggtcggcctggccctcttctgcctcgatggtggtcatgctgacgagcccgcgcgggaggcaggtccagacctcggcgcgaacgggtcggagagcgaggacgagggcgcgcaggccggagctgtccagggtcctgagacgctgcggagtcaggtcagtgggcagcggcggcgcgcggttgacttgcaggagtttttcaagggcgcgcgggaggtccagatggtacttgatctccaccgcgccgttggtggcgacgtcgatggcttgcagtgtcccgtgcccctggggagtgaccaccgtcccccgtttcttcttggcgggcggaagcggtttggcttccatggttaaaagcggcggcgaggacgcgcgccgggcggtaggggcggctcgggacccggaggcagtggtggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagacagttcgacagaatcaatctcggtatcattgacggcggcctgccgcagaatctcttgcacgtcgcccgagttgtcctggtaggcaatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtaaaccacggcgccctcgggatcgcgggcgcgcatgaccacctgggcgaggttgagctccacgtggcgcgcaaaaaccgcgtagttgcagaggcgctggtagaggtagttgagcgtggtggcaatgtgctcagtgacaaagaagtacataatccagcggcggagcggcatttcgctgacgtcgcccagggcttccaagcgctccatggcctcgtaaaagtccacggcgaagttgaaaaactgggagttgcgtgcagatacggtcaagtcctcctccagaagacggatgagctcggcgatggtggcgcgcacctcgcgctcgaaggctcccgggagttcctccacttcctcctcttcatccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggtcgcagcgtaaagacgccgccgcgcatctccaggtggcccggggggtccccgttgggcagggagagtgcgctgacgatgcatcttatcaattgccccgtagggactccgcgcaaggacctaagcgtctctagatccacgggatctgaaaaccgttgaacgaaggcttcgagccagtcgcagtcgcaaggtaggctgagcacggtttcttctggcggcggtggggtgtgggcgggggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatacgcgtgagcccaaacccgcgctgcggctggacgagcgccaggtcagcgacgacgcgctcggcgaggatggcctgctggatctgggtgagggtggtctggaagtcgtcaaagtcgacgaagcggtggtaggctccggtgttaatggtgtaggagcagttggccatgacggaccagttgacagtctggtgaccgggccgcgcgagctcgtggtacttgaggcgcgagtaggcgcgcgagtcgaagatgtagtcgttgcaggtgcgcaccaggtactggtagccgatgaggaagtgcggcggcggctggcggtagagcggccatcgctcggtggcgggggcgccgggcgctaggtcctcgagcatggtgcggtggtagccgtagatgtaccttgacatccaggtgatgccggcggcggtggtggaggcgcgagggaactcgcggacgcggttccagatgttgcgcagcggcaggaagtagttcatggtgggcacggtctggcccgtgaggcgcgcgcagtcgttgatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaggcctgcacaaaacctccaggatacggaggcgggtcgttttgcaaatttttggcggtcgaaaaaagctagtaagcgcggaaagcggccgaccgcaatggctcactgccgtagattggagaagaatcgccagggttgcgttgcggtgtgccccggttcgagaccgctcgggtcggccgaattccgcggctaacgagggcgtggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgccccagcagcagcaacttccagccactaccgccgcggccgccgtgagcggggccgggcagagtcagtatgacctggctttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcagcccgtttccacgcggggcgggagctgcggcgcggcctggacagaaagagggtgctgagggacgaggatttcgaggcggacgagctgacggggatcagccctgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccattgtgcagaaccccaccagcaaaccgctgacggcgcagctgttcctggtggtgcagcacagtcgggacaacgagacttttagggaggcgctgctgaatatcaccgagcccgagggccgctggcttctggacctggtgaatattctgcagagcatcgtggtgcaggagcgcgggctgccgctgtccgagaagctggcggccatcaacttttcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcgccgcgcggtaagcgccagcaggcggcgcgagctgagcgatcaggagctgatgcacagcctgcagcgggccctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtgctggccatcgtgaacgcgctggttgagaacaaggccattcgcggcgacgaggccgggctggtgtacaacgcactgctggagcgcgtggcccgctacaacagcaccaacgtgcagaccaacctggaccgcatggtgaccgacgtgcgcgaagccgtggcccagcgcgaacggttccaccgcgagtccaacctgggatccatggtggcactgaacgccttcctcagcacgcagcccgccaacgtgccccggggccaggaggactacaccaacttcattagcgccctgcggctaatggtgaccgaggtgccccagagcgaggtgtaccagtcgggcccggactacttcttccagaccagtcgccagggcttgcagaccgtgaacctgagtcaggctttcaagaacttgcagggactgtggggcgtgcaggctccggtcggggaccgcgcgacggtgtcgagcctgctgacgccgaactcgcgcctgctgctgctgctggtggcgcccttcacggacagcggtagtatcaaccgcaactcgtacctgggctacctgattaacctgtaccgcgaggccattggccaggcgcacgtggacgagcagacctaccaggagattacccacgtgagccgcgccctcggccaggacgacccgggcaatctggaagccaccctgaacttcttgctgaccaaccggtcgcagaagatcccgccccagtacgcgctgagcgccgaggaggagcgtatattgagatacgtgcagcaaagtgtgggactgttcctgatgcaggagggggccacccccagcgccgcgctcgacatgaccgcgcgcaacatggagcccagcatgtacgccagtaatcgcccgtttattaataagctgatggactacctgcatcgggcggccgccatgaactctgactatttcaccaacgccatcctgaacccccactggctcccgccgccggggttctacacgggcgagtacgacatgcccgaccccaatgacgggtttctgtgggacgacgtggacagcagcgtgttctccccccgaccgggtgctaacgagcgccccttgtggaagaaagagggcagcgaccggcgcccgtcctcggcgctgtccggccgcacgggtgctgccgcagcggtgcccgaggccgccagtccctttccgagcttgtcactgaacagcgtccgcagtagcgagctgggcaggatcacgcgcccgcgcttgctgggcgaggaggagtacttaaataactcgctgttgaggcccgagcgggagaagaacttccccaataacgggatagagagtctggtggataagatgagccgctggaagacgtacgcgcatgagcacagggacgatccccgggcaacgcagggggccaccagccggggcagtgccgcccgtaaacgccgctggcacgacaggcagcggggactgatgtgggacgatgaggattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcccccgctggaggctccttacgtgccaccgcggtacctggcgcctacggaggggcgaaacagcattcgttactcggagctggcacccttgtacgataccacccggttgtacctggtggacaacaagtcggcggacatcgcctcgctgaactaccagaacgaccacagcaactttctgaccaccgtggtgcagaacaacgatttcacccccacggaggccagcacccagaccatcaactttgacgagcgctcgcggtggggcggtcagctgaaaaccatcatgcataccaacatgcccaacgtgaacgagttcatgtacagcaacaagttcaaggcgcgggtcatggtctcccgcaagacccccaacggggtgacagtaggggatgattatgatggtagtcaggatgagctgaaatacgagtgggtggagtttgagctgcccgaaggcaacttctcggtgaccatgaccattgacctgatgaacaacgccatcatcgacaattacttggcagtggggcggcagaacggggtgctggagagcgacatcggcgtgaagttcgacacccggaacttcaggctgggttgggaccccgtgaccgagctggtcatgcccggggtgtacaccaacgaggccttccaccccgacatcgtgctgttgcccggctgcggggtggactttaccgagagccgcctcagtaatatgctgggcatccgcaagaggcagcccttccaggagggtttccagatcatgtacgaggacctggatggaggtaacatccccgcgctcttggatgtcgaggcctatgagaaaagcaaggaggagagcgtcgccgcgtcaaccgcagccgtagccaccgcctctaccgaggtccggggcgataattttgctagcgccgcagcagtggcggcggccaaggctgatgaaaccgaaagtaagatagttattcagccggtggagaaggatagcaaggataggagctacaacgtgctctcggacaagaaaaacaccgcctaccgcagctggtacctggcctacaactatggcgaccacgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcatgcccgtctactccaagagcttcttcaacgagcaggccgtctactcgcagcagctgcgcgccttcacctcgctcacgcacgtcttcaaccgcttccctgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggtctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgctcgcaactacacccccgccgccgcgcccgtctccaccgtggacgccgtcattgacagcgtggtgtccgacgcgcgccggtacgcccgcgccaagagccggcggcggcgcatcgcccggcggcaccgtagcaccaccgccatgcgtgcggcgcgagccttgctgcgcagggccaggcgcacgggacgcagggccatgctcagggcggccagacgcgcggcttcaggcgccagcgccggcaggactcggagacgcgcggccacggcggcggcagcggccatagccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagaaatccccgcaaaatcaagcgggtcaaaaaggacaaaaaggaagaagatgatgtggacgatatggtagagtttgtgcgcgagtttgccccccggaggcgcgtgcagtggcgcgggcggaaagtgcgtccggtgctgagacccggcaccacggtggttttcgcgcctggcgagcggtccggcacgacatccaagcgctcctacgatgaggtgtacggggacgaggatattctcgagcaggcggccgagcgcctgggcgagtttgcttacggcaagcgcaaccgccttgcgcccctgaaggaagaggtggtgtccatcccgctggaccacggcaaccccacgccgagtcttaagcccgtgaccctgcagcaggtgctgccgagcgcggcgccgcgtcggggcttgaagcgcgagggcgaggatgtgtaccccaccatgcagctgatggtgcccaagcgccagaagctggaagacgtgctggagaccatgaaggtggacccggacgtgcagcccgaggtcaaggtgaggcccatcaagcaggtggccccgggccttggcgtgcagaccgtggacatcaagatccccacggagcccatggaaacgcagaccgaggtcgtgaagcccatcaccagcaccatggaggtgcagacggatccttggatgccggcggcgccccgaaaaccccggcgcaagtacggcgcggccagcctgctgatgcccaactacgcgctgcatccttccatcatccccacgccgggctaccgcggcacgcgcttctaccacggctataccggctcccgccgccgcaagaccaccacccgccgccgtcgtcgccgcacagctgcaactcccgctgccgccctggtgcggagagtgtaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgccgccacccccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaactgaacgggggcgccttcaattggagcagtctctggagcgggcttaagaattttgggtccacgcttaaaacctatggcagcaaggcgtggaacagcaccacagggcaggcgctgagagataagctgaaagagcagaacttccagcagaaggtagtcgatggcctcgcctcaggcatcaacggggtggtggacctggccaatcaggccgtgcagcggcagatcaacagccgcctggacccggttccccccgccggctccgtggagatgccgcaggtggaggaggagctgcctcccctggacaagcggggcgacaagcgtccccgtcccgacgcggaggagacgctgctgacgcacacggacgaaccgcccccgtacgaggaggcggtgaaactgggcctgcccaccacgcgtcccattgcgcctctagctaccggggtgctgaaacccgagagtagcaagcccgcgaccttggacttgcctcctccgcccactccccgcccctccacagtggctaagcccctgccgccggtggccgtggcccgcgcgcgaccgggggctcgccctcaggcgaactggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagcacccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccaccaatgaaaagggaggacaggctaaacttaaagttggagatgatggagttccaaccaaagaatttgacatagacctggctttctttgatactcccggtggcactgtgaatggccaagatgagtataaagcagacattgtcatgtataccgaaaacgcctatctggaaactccagacacacatgtggtatacaaaccaggcaaggaagatgcaagttctgaaattaacctggttcagcagtccatgcccaacagacccaactacattgggttcagggacaactttattggtctcatgtattacaacagcactggcaatatgggggtgctggccggtcaggcctcacagctgaatgctgtggttgacttgcaagacagaaacactgagctgtcctaccagctcttgcttgactctctgggtgacagaacccggtatttcagtatgtggaatcaggcggtggacagttatgatcctgatgtgcgcattattgaaaaccatggtgtggaggatgaactgccaaactattgcttccccttggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggaaatcaacctccaagccaacctgtggaggagtttcctctactcgaacgtggccctgtacctgcccgactcttacaagtacacgccggccaacgtcaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgcctttcgcggctggtccttcacgcgtctcaagaccaaagagacgccctcgctgggctccgggttcgacccctacttcgtctactcgggctccatcccctacctcgacggcaccttctacctcaaccacaccttcaagaaggtctccatcaccttcgactcttccgtcagctggcccggcaacgaccggctcctgacgcccaacgagttcgaaatcaagcgcaccgtcgacggcgagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggttaactacaaggactaccaggccgtcaccctggcctaccaacacaacaactcgggcttcgttggatacctcgcgcccactatgcgccagggccagccctaccccgccaactacccctacccgctcatcggcaagagcgccgttaccagcgtcacccagaaaaagttcatctgcgacagggtcatgtggcgcatccccttctccagcaacttcatgtccatgggcgcgctcaccgacctcggccagaacatgctctatgctaactccgcccacgcgctagacatgaatttcgaagtcgaccccatggatgagtccacccttctctatgttgtcttcgaagtcttcgacgtcgtccgagtgcaccagccccaccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgattcccgggattcatggccccgcacaaggtggcctgcgccatcgtcaacacggccggccgcgagaccgggggcgagcattggctggccttcgcctggaacccgcgctcgaacacctgctacctcttcgaccccttcgggttctcggaccagcgcctcaagcaaatctaccagttcgagtacgagggactgctgcgccgcagcgccctggccaccaaggaccgctgcgttaccctggaaaagtccacccagaccgtgcagggtccgcgttcggccgcctgcgggcttttctgctgcatgttcctacacgccttcgtgcactggcccaaccgccccatggacaaaaatcccaccatgaacttgctgacgggggtgcccaacggcatgctccagtcgccccaggtggaacctaccctgcgccgcaaccaggaggcactctaccgcttcctcaactcccactctgcatactttcgctctcaccgcgcgcgcattgagaaggccaccgccttcgaccgcatgaatcaagacatgtaacagtgtgttttaaaatatgtttaataaacagcactttttatgtgacacatgcatttgagataattttattcttaaaaatcgaaggggttctgccgggaggtttcggcatggcccgcgggcagggacacgttgcggaactggtacttggccagccacttgaactcggggatcagcagtttcggcagcagggtgtcggggaacgagtcggtccacagcttccgcgtcagttgcagggcgcccagcaggtcgggcgcggagatcttgaaatcgcagttgggacccgcgttttgcgcgcgagagttgcggtacacagggttgcagcactggaacaccatcagggccggatgcttcacgctcgccagcaccgtagcgtcggtgatcccgtccacgtcgaggtcttcggcgttggccatcccgaagggggtcatcttgcaggtctgccggcccatggtgggcacgcagccgggcttgtggttgcaatcgcagtgcagggggatcagcatcatctgggcctggtcggcgttcatccccgggtacatggccttcatgaaagcctccagctgcttaaacgcctgctgggccttggctccctcggtgaagaagaccccgcaggacttgctagaaaactggttggtagcgcacccggcgtcgtgcacgcagcagcgcgcgtcgttgttggccagctgcaccacgctgcgcccccagcggttctgggtaatcttggcccggtcggggttctcctttagcgcgcgttgcccgttctcgcttgccacatccatctcgatcatgtgctccttctggatcatggtggtcccgtgcaggcaccgcagcttgccctcgacttcggtacagccgtgcagccacagcgcgcaccccgtgctctcccagttcttgtgggcgatctgggaatgcgcatgcacgaacccctgcaggaagcggcccatcatggtcgtcagggtcttgttactggtaaaggtcagcggaatgccgcggtgctcctcgttgatgtacaggtggcagatgcggcgatacacctcgccctgctcgggcatcagttggaagttggattttaggtcgctttccacacggtagcgctccatcagcatattcatgatttccatgcccttctcccaggccgatacaatgggcaggctcagggggttcgtcaccgccatcttagcgctagcagccttcgtcagcgggtcgttctcattgagagtctcaaagctccgcttgccgtccttctcggtgatccgcacgggggggtagctgaagcccacggccgccagctcctcctcggcctctctttcgtcctcgctgtcctggctgacgtcctgcaggggcacatgcttcgttttgcggggtttctttttgggcggctgctgcggcggcggtggttgttcctgaggcgagggggagcgcgagttctcgctcaccactactatctcttcttcttggtccgaggccacgcggcggtaggtatgtctcttcaggggcagaggcggaggcgacgggctctcgcggcccggcgggtggctggcagagccccttccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgccgcccagccccgccacctttgtcgcggccccagacatgcaagagatggaggaatccattcagattgacctgggctatgtgacgcccgcggagcacgaggaggagcttgcagtgcgcttttcaacccaggaagagatacaccaagaacagccagagcaggaagcaaagagcgagcatgactacctccaccagagcgggggggaggacgccctcatcaagcatctggcccggcaggccatcatcgtcaaggacgcgctgcttgaccgcaccgaggtgcccctcagcgtggaggagctcagccgcgcctacgagctcaacctcttctcgccgcgcgtgccccccaagcgccagcccaacggcacctgcgagcccaacccacgcctcaacttctacccggtcttcgcggtgcccgaggccctggccacctaccacatctttttcaagaaccaaaggatccctgtctcctgtcgcgccaaccgcacccgcgccgactcccttttcaacctgggccccggtgcccgcctacctgatatcgcctccttggaagaggttcccaagatcttcgagggtctgggcagcgacgagactcgggccgcaaacgctctgcaaggagaaggaggagatcatgagcaccacagcgccctggtggagttggaaggcgacaacgcgcgtctggcggtgctcaagcgcacgatcgagctgacccatttcgcctacccggcgcttaacctgccccccaaagtcatgagcacggttatggaccaggtgctcatcaagcgcgcgtcgcccatctccaaggagatgcaagaccccgagagctccgaggagggcaagcccgtggtcagcgacgagcagctggcgcggtggctgggaccccaagctagtccccagagcttggaagagcggcgcaagctcataatggccgtggtcctggtgaccgcggagctggagtgtctgcgccgcttcttcgccgacgcagaaactctgcgcaaggtcgaggagaacctgcactacatcttcaggcacgggttcgtacgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtttacctctacctctgccacacctggcagacagccatgggcgtgtggcagcagtgtctggaggagcagaacctaaaagagctctgcaagctcctgcagaagaacctcaaggccctgtggaccgggttcgacgagcgcaccaccgcctcggacctggcagacctcattttccccgagcgtctcaggctgacgctgcgcaacggtttgcccgactttatgagtcaaagcatgttgcaaaactttcgctctttcatcctcgaacgctccgggatcctgccggccacctgctccgcgctgccctcggacttcgtgccgctgaccttccgcgagtgccccccgccgctgtggagccactgctacctgctgcgcttggccaactacctggcctaccactcggacgtgatcgaggacgtcagcagcgagggcctgctcgagtgccactgccgctgcaacctctgcacgccgcaccgctccctggcctgcaacccccagctgctgagcgagacccagatcatcggcaccttcgagttgcaagggcccggcgatgagggttctgccgccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagctatccagaaatcccgccaagaattcttgctgaaaaagggccgcggggtctaccttgatccccagaccggtgaggagcttaaccccggcttcccccaggatgccccgaggaagcagcaagaagctgaaagtggagctgccgcccgtggaggatttggaggaagactgggagagcagtcaggcagaggaggaggagatggaagactgggacagcactcaggcagaggacagcctgcaagacagtctggaagacgaggaggaggcagaggaggtggaagaagtagccgccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaagcttgcgggggcaacatctcattcacccggcgctacctgctctttcaccgcggggtgaacttcccccgcaacatcttgcattactaccgtcacctccacagcccctactacttccaagaagaggcagaaaaagacaaaaccagcagctagaaaatccacagcggcggcggcaggtggactgaggatcgcggcgaacgagccggcgcagacccgggaactgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctatgagcaaagaaattcccacgccttacatgtggagctaccagccccagatgggcctggccgccggcgccgcccaggactactccacccgcatgaattggctcagcgccgggcccgggatgatctcacgggtgaatgacatccgcgcccaccgaaaccagatactcctagaacagtcagcgctcaccgccacgccccgcaatcacctcaatccgcgtaattggcccgccgccctagtgtaccaggaaattccccagcccacgaccgtactacttccgcgagacgcccaggccgaagtccagctgactaactcaggtgtccagctggcgggcggcgccaccctgtgtcgtcaccaccccgctcagggtataaagcggctggtgatccggggcagaggcacacagctcaacgacgaggtggtgagctcttcactgggtttgcgacctgacggagtcttccaactcgccggatcgggaagatcttccttcacgcctcgtcaggccgtgctgactttggagagttcttcctcgcaacctcgctcgggcggcatcggcactctccagtttgtggaggagttcactccctcggtctacttcaaccccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgccgagtttacctactttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgcatgaaagtctttgttgtctgctgtgtactgagtataataaaagctgagatcagcgactactccggactcgattgtgttcctgcatccctcaaccagtctctgaccttcaccgggaacgaaacagagctccatctccagtgtaagccccacaaaaagtacctcacctggctgcaccagggctccccaatcgccgttgttaaccactgcaacgacgacggagtcctgctgaacggccccgccaaccttactttttccacccgcagaagcaagctactgctcttccgacccttcctaccagggatctatcagtgcgtctcgggaccctgccatcacaccttccacctgatcccgaataccacctcttccccagcgccgctcctcactaacaaccaaactaaccaccaccaacgctaccgtcgagacctaggccccaatacatgcccatcttaaactatgaggccgagccacaacgagccatgcttcctgctattagttacttcaatctaaccggtggagatgactgacccactcaacaacactgtcaacgacctcctggacatggacggccgcggctcggagcagcgtctcgcccaactccgcattcgccagcagcaggagagagccgtcaaggagctgcaggacgcagtggccatccaccagtgcaagaaaggcatcttctgcctggtgaagcaggccaagatctccttcgaggtcacttccaccgaccatcgcctctcctacgagctcctgcagcagcgccagaagttcacctgcctggtcggagtcaaccccatcgtcatcacccagcagtctggcgataccaagggttgcatccactgctcctgcgactcccccgagtgcgttcacaccctgatcaagaccctatgcggcctccgcgacctcctccccatgaactaatcaactaaccccttaccccattacccatccagtaaaaaaaataaagattaaagagacgatgattttgaattgatcaataaagaatcacttacttgaaatctgaaaccaggtctctgtccatgttttctgtcagcagcacttcgctcccctcttcccagctctggtactgcaggccccggcgggctgcaaacttcctccacactctgaaggggatgtcaaattcctcctgtccctcaatcttcattttttatttctattagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaatggggctgtcaccctcaagctgggggagggggtggacctcgacgactcgggaaaactcatctccaaaaatgccaccaaggccactgcccctctcagtatttccaacaacaccatttcccttaacatggatgcccctctttacaacaacaatggaaagttaggcataagaataggagcacctctaaaggtagtagacttactaaacactttagctgtagcctatggatcgggtctaggtctcaagaataatgcccttacagttcagttagtttctccactcacttttgataacaaaggcaatgtaaaaattaacttagggaatggtccattaacagttgcggcaaaccgtctgagtgttacctgcaaaagaggtttatatgtcactactacaggagatgcactcgaaagcaacataagctgggctaaaggtataagatttgaaggaaatgcaatagcagcaaatattggcaaagggcttgaatttggtactactagttcagagtcagatgtcagcaatgcttatcctatccaagtaaaactaggtactggtctcacctttgacagcacaggtgccattgttgcttggaacaaagaggatgacaagcttacattatggaccacagccgacccatcgccaaattgcaaaatatactctgaaaaggatgcaaaacttacactttgcttgacaaagtgtggtagtcaaatattgggcactgtgacagtattggctgttaacaatgggagcttaaagcccattacaaacgcagtgagcactgcaattgtatatctcaagtttgatgctaatggagtcttgctaagcaactcaacactaaacaaagaatattggaatttcagaaagggagatgttacacctgccgaagcatacactaatgctataggttttatgcctaatataaaagcttaccccaaaaataccaatgtggcttcaaaaagtcatattgttggacaagtttacctaaatggagatgaaaccaaacctcttatgctaattatcacatttaatgaaactgatgatgcaacctgcacctactgcattacttttcaatggaaatgggataatagcaagtacacaggtgaaacacttgcaaccagctcctttcccttctcctacattgcccaagaataatcccaccctgcatgccaacccaccttttccctctatttataaatggaaactgaaacaaaaataaagttcaagtgttttattgattcaacagtttttcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattttcgtatttcacaaagcagaacctggtccgggcactgcacaccgctcgtcggcgacggtctcggcgcttcgagcgctcaatgttgaagttatagaacagccactccctcagaacgtgcagtatctcctgagcctcttgggtgatgaaaatcccatccgccctgatggctctgattacatcaaccacggtggaatgggccaaacccagccagatgatgcaattttgttgggtttcggtgacggcgggggagggaagaacaggaagaaccatgattaactttattccaaacggtctcggaacacttcaaaatgcaggtcccggaggtggcacctctcgcccccactgtgttggtggaaaataacagccaggtcaaaggtaacacggttctcgagatgttccacggtggcttccagcaaagcctccacgcgcacatccagaaacaagaggacagcgaaagcgggagcgttttctaattcctcaatcatcatattacactcctgcaccatgcctagataattttcatttttccagccttgaatgattcgtattagttcctgaggtaaatccaagccagccatgataaaaagctcgcgcagagcgccctccaccggcattcttaagcacaccctcataattccaacagattctgctcctggttcacctgtagtagattaacaagtggaatatcaattgctctgccgcaatccctaagctcctcccttagcagtaactgtatgtactcattcatatcttctccgaaatttttagccataggaccaccaggaacaagagaagggcaagccacattacagataaagcgaagtcctccccagtgagcattgccaaatgtaagattgaaataagcatgctggctagacccggtgatatcttccagataactggacagaaaatcaggcaagcaatttttaagaaaattaacaaaagaaaagtcgtctaggtgcacgtttagagcctcaggaacaacgatggaataagtgcaaggagtacgttccagcatggttagtgtttttggtgatctgtagaacaaaaaataaacatgcaatattaaaccatgctagcctggcgaacaggtggataaatcactctttccaacaccaggcaggctacagggtctccggcgcgaccattgtagaagctgacattatgattaaaaagcatcaccgacagaccttcccggtggccggcatggatgattcgagaagaagcatacactccgggaacattggcgtccgtgagtgaaaaaaagcgacctataaagccttgaggcactacaatgcttaatcttaattccagcaaagcgaccccatgcggatgaagcacaaaattggcaggtgcgtaaaaaatgtaattactccccttctgcacaggcagcaaagcccccgctccctccagaaacacatacaaaacctgagcgtccatagcttaccgagcacggcaggcgcaagagtcagagaaaaagctgagctctaacctaactgcccgcttctgtactcaatatatagccctaacctcactgacgtaaaggccaaggtctaaaaatacccgccaacacgcccagaaaccggtgacacactaaaaaaatacgtgcacttcctcaaacgcccaaactggcgtcatttccggtttcccacgctacgtcacctctcaacgactttcaaattccgtcgaccgttaattaaacacatcagttaccccgcccctaacgaacgccgctgtcacagccaatcagcgcgccccatccccaaattttcacgccttatttgcatattaactcacacaaaaaaaataaggtatattattgatgatg

SEQ ID NO: 60 - protein, 294 aa, Artificial Sequence
  PtroAdV-1 hexon HVRs
TSTDATTTTTHSFGLAAMKGDNITSDGLQIGTDATSGEEKPIYADKLYQPEPQIGEESWTDTDGTNEKFGGRVLKKDTSMKPCYGSFAKPTNNKGGQAKQKATEGTTVEYDVDMNFFDGRDAAANFTPEVVLYAENVDLETPDTHIVYKPGTSDVSSHVNLGQQAMPNRPNYIGFRDNFIGLMYYNSTGNMGVLAGQASQLNAVVDLQDRNTELSYQLLLDSLGDRTRYFSMWNQAVDSYDPDVRIIENHGIEDELPNYCFPIDAVGITKTYQGIKTQNGQTTTWEKDTSVSTA

SEQ ID NO: 61 - protein, 302 aa, Artificial Sequence
  PtroAdV-13 hexon HVRs
AKPGNGGTMETHTYGVAPMGGENITKDGLQIGTDATADQNKPIYADKTFQPEPQVGEENWQETESFYGGRALKKDTNMKPCYGSYARPTNEKGGQAKLKVGDDGVPTKEFDIDLAFFDTPGGTVNGQDEYKADIVMYTENAYLETPDTHVVYKPGKEDASSEINLVQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGSGTNAAYQGVKVKNGEDGDLESEWENDDTVAAR

SEQ ID NO: 62 - protein, 179 aa, Artificial Sequence
  BB21 Fiber Knob Polypeptide
TLWTTADPSPNCKIYSEKDAKLTLCLTKCGSQILGTVTVLAVNNGSLNPITNAVSTAIVYLKFDANGVLLSNSTLNKEYWNFRKGDVTPAEAYTNAIGFMPNIKAYPKNTNVASKSHIVGQVYLNGDETKPLMLIITFNETDDATCTYCITFQWKWDNSKYTGETLATSSFPFSYIAQE

SEQ ID NO: 63 - protein, 179 aa, Artificial Sequence
  BB21 Fiber Variant Knob polypeptide
TLWTTADPSPNCKIYSEKDAKLTLCLTKCGSQILGTVTVLAVNNGSLKPITNAVSTAIVYLKFDANGVLLSNSTLNKEYWNFRKGDVTPAEAYTNAIGFMPNIKAYPKNTNVASKSHIVGQVYLNGDETKPLMLIITFNETDDATCTYCITFQWKWDNSKYTGETLATSSFPFSYIAQE

SEQ ID NO: 64 - protein, 179 aa, Artificial Sequence
  BB24 Fiber Knob polypeptide
TLWTTADPSPNCKIYSEKDAKLTLCLTKCGSQILGTVTVLAVNNGSLNPITNIVSTAIVYLKFDANGVLLSNSTLNKEYWNFRKGDVTPAEAYTNAIGFMPNIKAYPKNTNVASKSHIVGQVYLNGDETKPLMLIITFNETDDETCTYCITFQWKWDNSKYTGETLATSSFPFSYIAQE

It is claimed:

1. An adenoviral vector comprising:
   (a) at least one transgene; and
   (b) a nucleic acid sequence encoding a fiber polypeptide, wherein the fiber polypeptide comprises an amino acid sequence with at least 98% identity to amino acids 6-375 of SEQ ID NO:2.

2. The adenoviral vector of claim 1, wherein the fiber polypeptide comprises an amino acid sequence selected from a BB21 fiber polypeptide (SEQ ID NO:2), a BB21 fiber variant polypeptide (SEQ ID NO:3), or a BB24 fiber polypeptide (SEQ ID NO:4).

3. The adenoviral vector of claim 1, further comprising a nucleic acid sequence encoding a hexon polypeptide comprising a hexon hypervariable regions-encompassing polypeptide comprising an amino acid sequence selected from SEQ ID NO:5 or SEQ ID NO:6.

4. The adenoviral vector of claim 3, wherein the hexon polypeptide comprises an amino acid sequence selected from a BB21 hexon polypeptide (SEQ ID NO:7) or a BB24 hexon polypeptide (SEQ ID NO:8).

5. The adenoviral vector of claim 1, wherein the adenoviral vector further comprises an E1 deletion.

6. The adenoviral vector of claim 1, wherein the adenoviral vector further comprises an E3 deletion.

7. The adenoviral vector of claim 1, wherein the adenoviral vector is a chimeric adenoviral vector comprising one or more human adenoviral nucleic acid sequences.

8. The adenoviral vector of claim 7, wherein the human adenoviral nucleic acid sequences are from human adenovirus-4, human adenovirus-5, human adenovirus-26, or human adenovirus-35.

9. The adenoviral vector of claim 8, wherein the adenoviral vector comprises a human adenovirus-5 (hAdV-5) E4 orf6.

10. The adenoviral vector of claim 1, wherein the transgene is located at an E1 deletion site, at an E3 deletion site, or adjacent to a right inverted terminal repeat (rITR).

11. The adenoviral vector of claim 1, wherein the adenoviral vector comprises a nucleic acid sequence selected from the group consisting of SEQ ID NO:28, SEQ ID NO:29, SEQ ID NO:30, and SEQ ID NO:31.

12. The adenoviral vector of claim 1, wherein the adenoviral vector comprises a nucleic acid sequence selected from SEQ ID NO:53 or SEQ ID NO:57.

13. A vaccine comprising an adenoviral vector according to claim 1 and a pharmaceutically acceptable carrier.

14. A method for inducing an immune response in a subject in need thereof, the method comprising administering to the subject the vaccine of claim 13.

15. A method of producing a vaccine, comprising combining an adenoviral vector according to claim 1 with a pharmaceutically acceptable carrier.

16. An isolated recombinant cell comprising the adenoviral vector of claim 1.

17. An isolated recombinant cell comprising the adenoviral vector of claim 2.

18. An immunogenic composition comprising the adenoviral vector of claim 1.

19. A vaccine comprising an adenoviral vector according to claim 2, wherein the transgene encodes an antigen, and a pharmaceutically acceptable carrier.

20. A vaccine comprising an adenoviral vector according to claim 3, wherein the transgene encodes an antigen, and a pharmaceutically acceptable carrier.

21. A vaccine comprising an adenoviral vector according to claim 4, wherein the transgene encodes an antigen, and a pharmaceutically acceptable carrier.

22. A vaccine comprising an adenoviral vector according to claim 5, wherein the transgene encodes an antigen, and a pharmaceutically acceptable carrier.

23. A vaccine comprising an adenoviral vector according to claim 8, wherein the transgene encodes an antigen, and a pharmaceutically acceptable carrier.

24. A method of producing a vector, comprising;
(a) growing the recombinant cell of claim 16 under conditions for production of the vector;
(b) isolating the vector from the recombinant cell.

25. A method of inducing an immune response in a subject in need thereof, comprising administering to the subject the immunogenic composition of claim 1.

* * * * *